US009884108B2

(12) United States Patent
Campos-Neto et al.

(10) Patent No.: US 9,884,108 B2
(45) Date of Patent: Feb. 6, 2018

(54) VACCINE AND THERAPEUTIC DELIVERY SYSTEM

(71) Applicant: Forsyth Dental Infirmary for Children, Cambridge, MA (US)

(72) Inventors: Antonio Campos-Neto, Westborough, MA (US); Mark Cayabyab, San Jose, CA (US); Margaret Duncan, Brookline, MA (US)

(73) Assignee: Forsyth Dental Infirmary for Children, Cambridge, MA (US)

( * ) Notice: Subject to any disclaimer, the term of this patent is extended or adjusted under 35 U.S.C. 154(b) by 0 days.

(21) Appl. No.: 15/172,947

(22) Filed: Jun. 3, 2016

(65) Prior Publication Data

US 2016/0354462 A1 Dec. 8, 2016

Related U.S. Application Data

(63) Continuation of application No. 13/624,146, filed on Sep. 21, 2012, now Pat. No. 9,376,686.
(Continued)

(51) Int. Cl.
*A61K 39/085* (2006.01)
*A61K 39/21* (2006.01)
(Continued)

(52) U.S. Cl.
CPC .............. *A61K 39/21* (2013.01); *A61K 39/04* (2013.01); *A61K 45/06* (2013.01); *C07K 14/00* (2013.01);
(Continued)

(58) Field of Classification Search
None
See application file for complete search history.

(56) References Cited

U.S. PATENT DOCUMENTS

| | | | | |
|---|---|---|---|---|
| 5,821,088 A * | 10/1998 | Darzins | C07K 14/31 | 435/219 |
| 2005/0008618 A1 * | 1/2005 | Kaufman | A61K 39/00 | 424/93.2 |

(Continued)

FOREIGN PATENT DOCUMENTS

| | | | | |
|---|---|---|---|---|
| GB | WO 2004072093 A2 * | 8/2004 | C07K 14/315 |
| WO | WO-1988/005823 A2 | 8/1988 | |
| WO | WO-1993/018163 A2 | 9/1993 | |

OTHER PUBLICATIONS

Denapaite et al., "The Genome of *Streptococcus mitis* B6—What Is a Commensal?" PLoS One 5(2): e9426 (2010).*

(Continued)

*Primary Examiner* — Janet L Andres
*Assistant Examiner* — M. Franco Salvoza
(74) *Attorney, Agent, or Firm* — Foley Hoag LLP

(57) ABSTRACT

The present invention relates to a new vaccine delivery system. In particular, the present invention includes compositions and methods of integrally transformed non-pathogenic, commensal bacteria that can express a nucleic acid molecule of a foreign polypeptide, wherein the nucleic acid molecule that encodes the foreign polypeptide is stably integrated into genomic DNA of the bacteria. The foreign polypeptide includes a vaccine antigen that elicits an immunogenic response, an inhibitor of a pathogen, or an immune booster or modulator.

5 Claims, 33 Drawing Sheets

Mean percentage DNA probe count for samples from human oral cavity in 225 healthy subjects *(adapted from Mager, DL, Ximenez-Fyvie, LA, Haffajee, AD & Socransky, SS. J Clin Periodontol 2003; 30: 644–654)*

Related U.S. Application Data

(60) Provisional application No. 61/538,346, filed on Sep. 23, 2011.

(51) Int. Cl.

| | |
|---|---|
| ***A01N 63/00*** | (2006.01) |
| ***C12P 21/04*** | (2006.01) |
| ***C12N 15/74*** | (2006.01) |
| ***C07K 14/00*** | (2006.01) |
| ***C07K 14/155*** | (2006.01) |
| ***C07K 14/16*** | (2006.01) |
| ***C07K 14/35*** | (2006.01) |
| ***C07K 14/005*** | (2006.01) |
| ***C07K 14/315*** | (2006.01) |
| ***A61K 39/04*** | (2006.01) |
| ***A61K 45/06*** | (2006.01) |
| ***C12N 7/00*** | (2006.01) |
| ***C12N 9/44*** | (2006.01) |
| *A61K 39/00* | (2006.01) |

(52) U.S. Cl.

CPC .......... *C07K 14/005* (2013.01); *C07K 14/155* (2013.01); *C07K 14/162* (2013.01); *C07K 14/315* (2013.01); *C07K 14/35* (2013.01); *C12N 7/00* (2013.01); *C12N 9/2457* (2013.01); *C12N 15/74* (2013.01); *C12N 15/746* (2013.01); *C12Y 302/01041* (2013.01); *A61K 2039/523* (2013.01); *A61K 2039/542* (2013.01); *A61K 2039/572* (2013.01); *C07K 2319/02* (2013.01); *C07K 2319/40* (2013.01); *C12N 2740/15022* (2013.01); *C12N 2740/15033* (2013.01); *C12N 2740/16022* (2013.01); *C12N 2740/16033* (2013.01); *C12N 2740/16034* (2013.01); *C12N 2740/16051* (2013.01); *C12N 2740/16071* (2013.01); *C12N 2740/16111* (2013.01); *C12N 2740/16122* (2013.01); *C12N 2740/16134* (2013.01); *C12N 2740/16171* (2013.01)

(56) References Cited

U.S. PATENT DOCUMENTS

2008/0167238 A1* 7/2008 Rosen .................. C07K 14/765 514/3.8

2012/0282293 A1 11/2012 Galen

OTHER PUBLICATIONS

Waterhouse et al., "Dispensable genes and foreign DNA in *Streptococcus mutans*," Microbiology 152:1777-1788 (2006).*

Pozzi et al., "Delivery and expression of a heterologous antigen on the surface of *Streptococci*," Infection and Immunity, vol. 60, No. 5: pp. 1902-1907 (1992).*

Zahner et al., "Mitis Group *Streptococci* Express Variable Pilus Islet 2 Pili," PLoS One 6 (9): e25124 (2011).*

Cvitokovitch, "Genetic Competence and Transformation in Oral *Streptococci*," Crit Rev Oral Biol Med 12(3): 217-243 (2001).*

Ronda et al., "Characterization of genetic transformation in *Streptococcus oralis* NCTC 11427: Expression of the pneumococcal amidase in *S. oralis* using a new shuttle vector," Mol Gen Genet 215:53-57 (1988).*

Vorrasi et al., "Identification and characterization of amylase binding protein C (AbpC) from *Streptococcus mitis* NS51," Mol Oral Microbiol 25(2): 150-156 (2010).*

Erra-Pujada et al., "The Type II Pullanase of Thermococcus Hydrothermalis," J Bacteriol, 181(10): 3284-3287 (1999).

International Search Report for PCT/US2012/056616 dated Dec. 25, 2014.

Kirchherr, Jennifer L., et al., "Clonal Diversity and Turnover of *Streptococcus mitis* by 1 on Shedding and Nonshedding Oral Surfaces of Human Infants during the First Year of Life," Clin. Diagn. Lab. Immunol. 12(10): 1184-1190 (2005).

Mitchell et al., "Mechanism of Cell Surface Expression of the *Streptococcus mitis* Platelet Binding Proteins PbIA and PbIB," Molecular Microbiology, 64(3): 844-957 (2007).

Paterson et al., "The Biology of Gram-positive Sortase Enzymes," Trends in Microbiology, 12(2): 89-95 (2004).

Pozzi et al., "Expression of M6 Protein Gene of *Streptococcus pyogenes* in *Streptococcus gordonii* After Chromosomal Integration and Transcriptional Fusion," Infection and Immunity, 143: 449-457 (1992).

Takamatsu et al., "Binding of the *Streptococcus gordonii* Surface Glycoproteins GspB and Has to Specific Carbohydrate Structures of Platelet Membrane Glycoprotein Ib(alpha)," Molecular Microbiology, 58(2): 380-392 (2005).

Van Der Poll, T et al.; "Interleukin-6 gene-deficient mice show impaired defense against pneumoccoccal pneumonia," J. Infect. Dis., 176(2): 439-444 (1997).

Walker, GJ. "Metabolism of the reserve polysaccharide of *Streptococcus mitis*, Some properties of a pullulanase," Biochem J., 108(1): 33-40 (1968) (especially abstract).

Wyatt, Richard et al. "The antigenic structure of the HIV gp120 envelope glycoprotein," Nature, 393: 705-711 (1998). (Especially abstract).

* cited by examiner

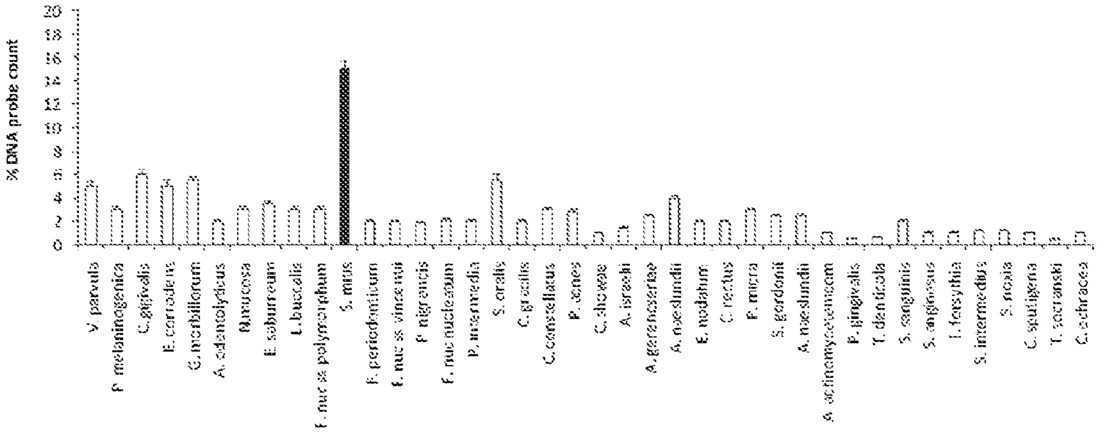
Fig. 1. Mean percentage DNA probe count for samples from human oral cavity in 225 healthy subjects *(adapted from Mager, DL, Ximenez-Fyvie, LA, Haffajee, AD & Socransky, SS. J Clin Periodontol 2003; 30: 644–654)*

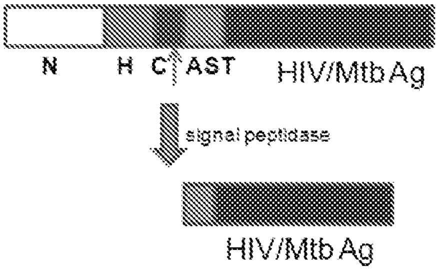
Fig. 2. Strategy for expressing HIV or Mtb antigens

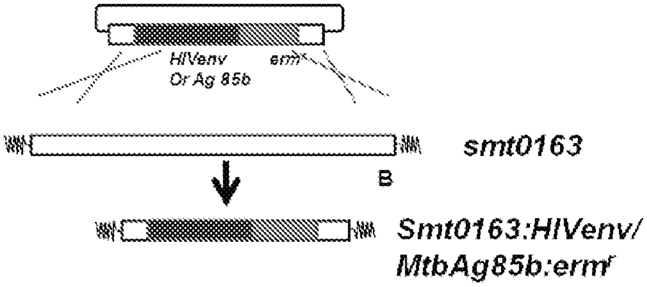
| Number of *erm^r* transformants per 5x10^7 cfu *S. mitis* | |
|---|---|
| Control | 0 |
| *SMT0163:HIVenv:erm^r* | 840 |
| *SMT0163:MtbAg85b:erm^r* | 735 |
| *SMT0163:erm^r* | 2,400 |
Fig. 3. Transformation of *S. mitis*

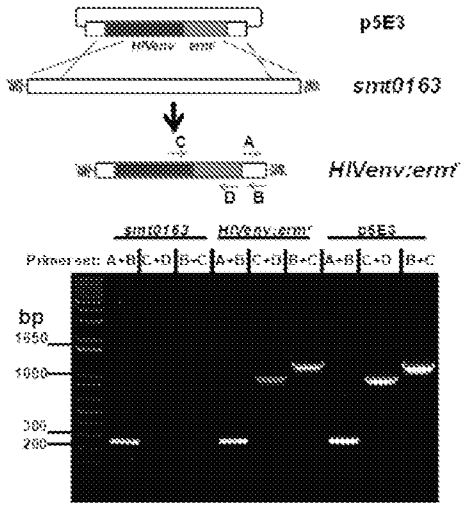
Fig. 4. Integration of foreign HIV gene in *S. mitis*

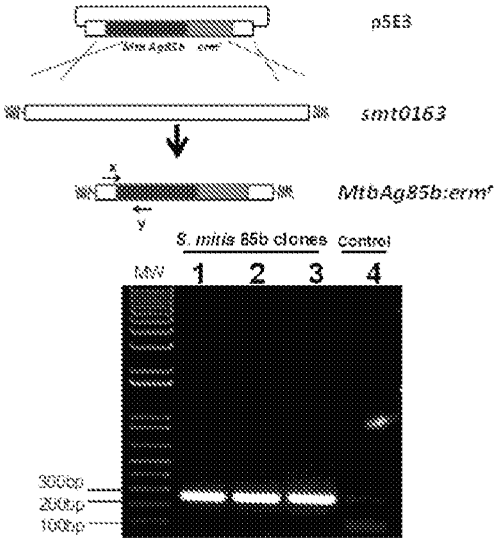
Fig. 5. Integration of foreign Mtb gene in *S. mitis*

Recombinant *S. mitis* expresses HIV-1 gp 120 antigen

| *rS. mitis* clone | Number of $Erm^r$ colonies/total no. of colonies streaked | | | | |
|---|---|---|---|---|---|
| | No. of generations | | | | |
| | 6 | 12 | 18 | 24 | 30 |
| HIVgp120A | 120/120 | 142/142 | 108/108 | 139/139 | 119/119 |
| HIVgp120B | 115/115 | 131/131 | 117/117 | 123/123 | 145/145 |
| HIVgp120C | 130/130 | 109/109 | 143/143 | 118/118 | 138/138 |
| HIVgp120D | 123/123 | 136/136 | 148/148 | 108/108 | 114/114 |

rSmitis HIVgp120 generations

Control 0 30 r*S. mitis* is stable

Vaccine elicited *S. mitis*-specific T cell responses in mice

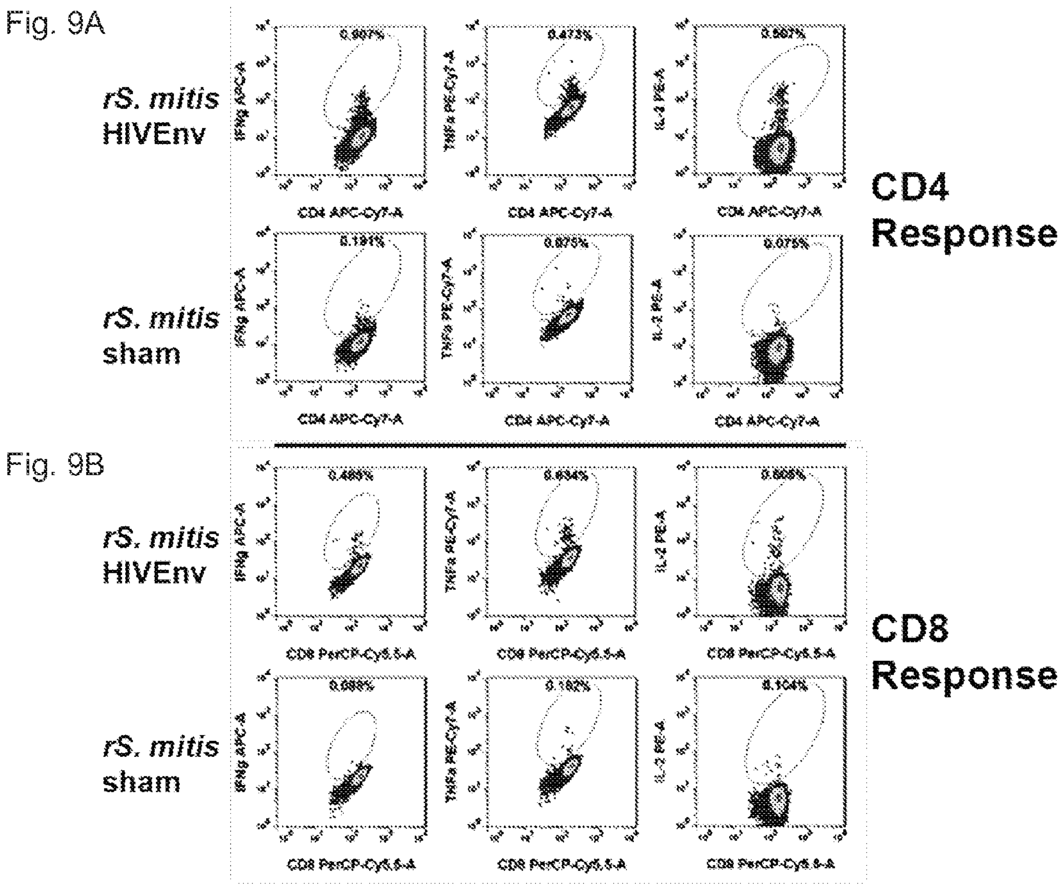
Vaccine elicited HIV-specific T cell responses in mice

Protein Sequence

SEQ ID NO: 2 - DGYVGAPAH

>MT0401

MIDGWTEEQHEPTVRHERPAAPQDVRRVMLLGSAEPSRELAIALQGLGAEVIAV

DGYVGAPAHRIADQSVVVTMTDAEELTAVIRRLQPDFLVTVTAAVSVDALDAVEQADGECTELVPNARAVRCTADR

EGLRRLAADQLGLPTAPFWFVGSLGELQAVAVHAGFPLLVSPVAGVAGQG

SSVVAGPNEVEPAWQRAAGHQVQPQTGGVSPRVCAESVVEIEFLVTMIVVCSQGPNGPLI

EFCAPIGHRDADAGELESWQPQKLSTAALDAAKSIAARIVKALGGRGVFGVELMINGDEV

YFADVTVCPAGSAWVTVRSQRLSVFELQARAILGLAVDTLMISPGAARVINPDHTAGRAA

VGAAPPADALTGALGVPESDVVIFGRGLGVALATAPEVAIARERAREVASRLNVPDSRE (SEQ ID NO: 4)

DNA Sequence

SEQ ID NO: 1 - GACGGCTATGTCGGCGCGCCTGCCCAC

>MT0401

GTGATCGACGGCTGGACGGAAGAACAGCACGAACCCACCGTTAGGCATGAGCGCCCAGCA

GCTCCCCAAGACGTTCGGCGGGTGATGTTGCTGGGTTCGGCCGAACCCAGCCGGGAGCTG

GCGATCGCGTTGCAGGGCTTGGGCGCGGAGGTGATCGCCGTCGACGGCTATGTCGGCGCGCCTGCCCACC

GGATAGCCGACCAGTCGGTGGTGGTCACCATGACCGATGCTGAAGAGCTGACGGCGGTGATCCGGCGGCTG

CAACCGGATTTCTTGGTGACGGTCACCGCCGCGGTGTCTGTGGATGCTCTCGATGCCGTCGAGCAAGCCGAC

GGCGAGTGCACTGAGCTGGTGCCGAACGCCCGTGCCGTCCGGTGCACGGCCGACCGGGAGGGCCTGCGCC

GGCTGGCCGCCGATCAGCTCGGCCTGCCCACAGCCCCGTTCTGGTTCGTCGGATCCCTTGGCGAACTTCAAG

CGGTGGCCGTCCATGCTGGGTTTCCGTTGCTGGTGAGCCCGGTGGCAGGGGTGGCTGGCCAGGGTAGCTCG

GTGGTCGCCGGGCCCAACGAGGTCGAGCCCGCCTGGCAGCGCGCGGCAGGCCATCAAGTACAGCCGCAGA

CTGGGGGAGTGAGCCCTCGGGTGTGCGCCGAGTCGGTGGTCGAGATCGAGTTTTTGGTCACCATGATCGTTG

TGTGCAGTCAGGGCCCGAACGGGCCGCTCATCGAGTTCTGTGCACCTATCGGTCATCGCGACGCCGATGCC

GGTGAGTTGGAATCCTGGCAACCGCAGAAGCTGAGCACGGCGGCGCTGGACGCGGCCAAGTCGATCGCCGC

GCGCATCGTCAAGGCGCTCGGGGGACGCGGGGTTTTCGGCGTCGAATTGATGATCAACGGCGATGAGGTGT

ATTTCGCCGATGTCACCGTGTGTCCTGCCGGGAGTGCCTGGGTCACCGTGCGCAGCCAGCGGCTTTCGGTGT

TCGAACTGCAGGCCCGGGCGATCCTGGGTCTGGCGGTGGACACCCTGATGATCTCGCCGGGTGCCGCGCG

GGTGATCAACCCGGACCACACGGCAGGCCGGGCAGCGGTCGGCGCCGCACCACCTGCCGATGCGCTGACC

GGTGCGCTCGGTGTGCCGGAAAGCGACGTCGTGATATTCGGCCGCGGGCTTGGGGTGGCGCTGGCCACCG

CACCCGAGGTGGCAATCGCCCGCGAACGCGCCCGCGAAGTTGCATCTCGGCTAAATGTGCCAGACTCACGC

GAGTGA (SEQ ID NO: 3)

Fig. 10A

Protein Sequence

SEQ ID NO: 6 - LAAVVGVVLAQVL

>Mb0073
MLFAALRDMQWRKRRLVITIISTGLIFGMTLVLTGLANGFRVEARHTVDSMGVDVFVVRS
GAAGPFLGSIPFPDVDLARVAAEPGVMAAAPLGSVGTIMKEGTSTRNVTVFGAPEHGPGM
PRVSEGRSPSKPDEVAASSTMGRHLGDTVEVGARRLRVVGIVPNSTALAKIPNVFLTTEG
LQKLAYNGQPNITSIGIIGMPRQLPEGYQTFDRVGAVNDLVRPLKVAVNSISIVAVLLWI
VAVLIVGSVVYLSALERLRDFAVFKAIGTPTRSIMAGLALQALVIAL<u>LAAVVGVVLAQVL</u>
APLFPMIVAVPVGAYLALPVAAIVIGLFASVAGLKRVVTVDPAQAFGGP (SEQ ID NO: 8)

DNA Sequence

SEQ ID NO: 5 - CTTGCGGCGGTGGTGGGCGTCGTCCTGGCGCAGGTGTTG

>Mb0073
ATGCTCTTCGCGGCCCTGCGTGACATGCAATGGAGAAAGCGCCGCCTGGTCATCACGATC
ATCAGCACCGGGCTGATCTTCGGGATGACGCTTGTTTTGACCGGACTCGCGAACGGCTTC
CGGGTGGAGGCCCGGCACACCGTCGATTCCATGGGTGTCGATGTATTCGTCGTCAGATCC
GGCGCTGCTGGACCTTTTCTGGGTTCAATACCGTTTCCCGATGTTGACCTGGCCCGAGTG
GCCGCTGAACCCGGTGTCATGGCCGCGGCCCCGTTGGGCAGCGTGGGGACGATCATGAAA
GAAGGCACGTCGACGCGAAACGTCACGGTCTTCGGCGCGCCCGAGCACGGACCTGGCATG
CCACGGGTCTCAGAGGGTCGGTCACCGTCGAAACCGGACGAAGTCGCGGCATCGAGCACG
ATGGGCCGACACCTCGGTGACACTGTCGAGGTCGGCGCGCGCAGATTGCGGGTCGTTGGC
ATTGTGCCGAATTCCACCGCGCTGGCCAAGATCCCCAATGTCTTCCTCACGACCGAGGGC
TTACAGAAATTGGCGTACAACGGGCAGCCGAATATCACGTCCATCGGGATCATAGGTATG
CCCCGACAGCTGCCGGAGGGTTACCAGACTTTCGATCGGGTGGGCGCTGTCAATGATTTG
GTGCGCCCATTGAAGGTCGCAGTGAATTCGATCTCGATCGTGGCTGTTTTGCTGTGGATT
GTGGCGGTGCTGATCGTCGGCTCGGTGGTGTACCTTTCGGCTCTTGAGCGGCTACGTGAC
TTCGCGGTGTTCAAGGCGATTGGCACGCCAACGCGCTCGATTATGGCCGGGCTCGCATTA
CAGGCGCTGGTCATTGCGTTG<u>CTTGCGGCGGTGGTGGGCGTCGTCCTGGCGCAGGTGTTG</u>
GCACCACTGTTTCCGATGATTGTCGCGGTACCCGTCGGTGCTTACCTGGCGCTACCGGTG
GCCGCGATCGTCATCGGTCTGTTCGCTAGTGTTGCCGGATTGAAGCGCGTGGTGACGGTC
GATCCCGCGCAGGCGTTCGGAGGTCCCTAG (SEQ ID NO: 7)

Fig. 10B

Protein Sequence

SEQ ID NO: 10 - RSGAATPVR

>MT2160.1
MPAAPSTREKDCMLVLHGFWSNSGGMRLWAEDSDLLVKSPSQALRSGAATPVRGAR (SEQ ID NO: 12)

DNA Sequence

SEQ ID NO: 9 - CGCTCCGGCGCGGCCACACCCGTTCGC

>MT2160.1
GTGCCGGCCGCTCCGTCGACAAGAGAGAAGGACTGCATGCTGGTTTTGCACGGCTTCTGG
TCCAACTCCGGCGGGATGCGGCTGTGGGCGGAGGACTCCGATCTGCTGGTGAAGAGCCCG
AGTCAGGCGCTGCGCTCCGGCGCGGCCACACCCGTTCGCGGCGCCCGCTGA (SEQ ID NO: 11)

Fig. 10C

Protein Sequence

SEQ ID NO: 14 - TCLPFAL

>MT0910.2
MSAPPAQAPVCGALAARPTAPGNASCTRPAKRDCRYGSRCETCLPFALAKDCRQASSRLQ
AATEPDETTTTTSVISMRSPGSLQYQPAT (SEQ ID NO: 16)

DNA Sequence

SEQ ID NO: 13 - ACCTGCCTCCCATTCGCACTA

>MT0910.2
ATGTCCGCGCCACCCGCTCAAGCGCCGGTATGTGGCGCCTTGGCGGCTAGGCCAACCGCC
CCCGGCAACGCCAGCTGCACACGCCCAGCGAAGCGCGATTGTCGGTACGGGTCGCGCTGC
GAAACCTGCCTCCCATTCGCACTAGCAAAAGACTGTCGACAAGCGAGCAGTCGACTTCAG
GCCGCGACCGAACCCGACGAGACGACAACAACATCTGTCATCTCAATGCGCTCACCAGGA
TCGCTACAATATCAGCCAGCTACATGA (SEQ ID NO: 15)

Fig. 10D

Protein Sequence

SEQ ID NO: 18 - TTMPLFAD

>Mb1654c
MPEVTREEPAIDGWFTTDKAGNPHLLGGKCPQCGTYVFPPRADNCPNPACGSDTLESVGL
STRGKLWSYTENRYAPPPPYPAPDPFEPFAVAAVELADEGLIVLGKVVDGTLAADLKVGM
EMELTTMPLFADDDGVQRIVYAWRIPSRAGDDAERSDAEERRR (SEQ ID NO: 20)

DNA Sequence

SEQ ID NO: 17 - ACGACCATGCCGCTGTTCGCCGAC

>Mb1654c
GTGCCAGAGGTCACCCGTGAAGAACCGGCAATCGATGGATGGTTCACCACCGATAAGGCC
GGCAACCCGCATCTGCTCGGCGGCAAGTGTCCCCAGTGCGGCACGTACGTCTTCCCACCC
CGGGCGGACAATTGTCCGAATCCGGCTTGCGGCAGCGACACACTAGAGTCGGTCGGACTG
TCGACCCGCGGAAAGCTTTGGAGCTACACCGAAAACCGGTACGCCCCGCCACCGCCGTAC
CCGGCACCCGACCCCTTTGAGCCGTTTGCCGTGGCCGCGGTGGAACTGGCCGACGAGGGA
CTGATCGTGCTGGGCAAAGTGGTCGATGGCACGCTGGCCGCCGATCTGAAGGTCGGCATG
GAGATGGAGCTGACGACCATGCCGCTGTTCGCCGACGACGACGGTGTGCAGCGCATCGTC
TACGCGTGGCGGATCCCATCGCGCGCCGGCGACGATGCAGAGCGCAGCGATGCTGAGGAG
CGGCGCCGATGA (SEQ ID NO: 19)

Fig. 10E

Protein Sequence

SEQ ID NO: 22 – VLVALAALGTQPWQDFAEQETAGLAIILDNVTHGEWASTILAAGAVV

>Mb2347c

MPTTSMSLRELMLRRRPVSGAPVASGASGNLKRSFGTFQLTMFGVGATIGTGIFFVLAQAVPEAGPGVIVSFIIAGIA
AGLAAICYAELASAVPISGSAYSYAYTTLGEAVAMVVAACLLLEYGVATAAVAVGWSGYVNKLLSNLFGFQMPHVLS
AAPWDTHPGWVNLPAVILIGLCALLLIRGASESARVNAIMVLIKLGVLGMFMIIAFSAYSADHLKDFVPFGVAGIGSAA
GTIFFSYIGLDAVSTAGDEVKDPQKTMPRALIAALVVVTGVY**VLVALAALGTQPWQDFAEQETAGLAIILDNVTHG
EWASTILAAGAVV**SIFTVTLVTMYGQTRILFAMGRDGLLPARFAKVNPRTMTPVHNTVIVAIFASTLAAFIPLDSLAD
MVSIGTLTAFSVVAVGVIVLRVREPDLPRGFKVPGYPVTPVLSVLACGYILASLHWYTWLAFSGWVAVAVIFYLMWG
RHHSALNEEVP (SEQ ID NO: 24)

DNA Sequence

SEQ ID NO: 21 -
GTGCTGGTCGCACTGGCCGCGCTGGGCACCCAACCGTGGCAGGACTTCGCAGAGCAGGAAACCGCCGGGC
TGGCCATCATCTTGGACAACGTCACGCATGGCGAATGGGCCAGCACGATTCTGGCCGCCGGTGCGGTGGTC

>Mb2347c

TTGCCGACAACGTCGATGAGCCTTCGAGAACTGATGCTGCGGCGCCGCCCGGTGAGCGGCGCCCCGGTCGC
ATCCGGGGCATCGGGGAACCTCAAGCGGAGTTTCGGCACCTTCCAGCTGACCATGTTCGGGGTTGGCGCGA
CGATAGGTACCGGCATCTTTTTCGTGCTTGCCCAGGCAGTTCCAGAGGCCGGCCCGGGCGTGATTGTTTCGT
TCATCATCGCCGGCATCGCCGCTGGGCTCGCGGCTATCTGCTACGCGGAACTGGCTTCCGCCGTGCCGATTT
CCGGGTCGGCGTACTCCTACGCGTACACGACGCTGGGCGAGGCGGTCGCGATGGTGGTGGCGGCCTGCCT
ACTGCTGGAATACGGGGTAGCCACCGCAGCGGTCGCGGTCGGCTGGAGTGGCTACGTGAACAAGCTGCTGA
GTAATCTGTTCGGATTTCAGATGCCGCACGTATTGTCGGCGGCGCCGTGGGACACCCATCCCGGTTGGGTGA
ACCTGCCCGCCGTCATCCTGATCGGGCTATGCGCGCTGCTGTTGATTCGAGGGGCCAGCGAGTCGGCGAGG
GTCAACGCGATCATGGTGCTGATCAAGCTCGGCGTGCTGGGCATGTTCATGATCATCGCGTTCAGCGCGTAC
AGCGCCGACCACCTCAAGGATTTCGTCCCATTCGGCGTCGCCGGCATCGGCTCCGCGGCGGGCACGATCTT
CTTCTCATACATCGGCCTTGACGCGGTGTCGACCGCCGGCGACGAGGTGAAGGACCCGCAGAAGACCATGC
CGCGTGCGCTGATCGCAGCGCTGGTGGTCGTCACCGGTGTCTAC**GTGCTGGTCGCACTGGCCGCGCTGGGC
ACCCAACCGTGGCAGGACTTCGCAGAGCAGGAAACCGCCGGGCTGGCCATCATCTTGGACAACGTCACGCA
TGGCGAATGGGCCAGCACGATTCTGGCCGCCGGTGCGGTGGTC**TCGATTTTCACCGTCACGCTGGTCACCAT
GTACGGCCAGACCCGGATCCTGTTCGCGATGGGGCGCGACGGGCTGCTGCCGGCGCGGTTCGCGAAGGTG
AATCCGCGCACCATGACGCCGGTGCACAACACGGTGATCGTCGCGATCTTCGCATCGACGCTGGCCGCCTTC
ATACCGCTGGATAGCTTGGCGGACATGGTGTCCATCGGCACGCTCACCGCGTTCAGCGTGGTGGCTGTGGGT
GTGATCGTTCTACGGGTGCGCGAGCCCGACTTACCCCGAGGGTTCAAGGTACCCGGTTACCCTGTGACGCCT
GTTCTTTCGGTGCTGGCCTGCGGGTATATCCTGGCCAGCTTGCACTGGTACACCTGGCTGGCGTTCAGCGGA
TGGGTGGCGGTGGCAGTGATCTTTTACCTGATGTGGGGTCGGCACCACAGTGCGCTCAACGAGGAAGTGCC
GTGA (SEQ ID NO: 23)

Fig. 10F

Protein Sequence

SEQ ID NO: 26 - CAVVLATMPPLLSAIANA

>MT1515

MTLTACEVTAAEAPFDRVSKTIPHPLSWGAALWSVVSVRWATVALLLFLAGLVAQLNGAPEAMWWTLYLACYLAG
GWGSAWAGAQALRNKALDVDLLMIAAAVGAVAIGQIFDGALLIVIFATSGALDDIATRHTAESVKGLLDLAPDQAVVV
QGDGSERVVAASELVVGDRVVVRPGDRIPADGAVLSGASDVDQRSITGESMPVAKARGDEVFAGTVNGSGVLHL
VVTRDPSQTVVARIVELVADASATKAKTQLFIEKIEQRYSLGMVAATLALIVIPLMFGADLRPVLLRAMTFMIVASPCA
VVLATMPPLLSAIANAGRHGVLVKSAVVVERLADTSIVALDKTGTLTRGIPRLASVAPLDPNVVDARRLLQLAA
AAEQSSEHPLGRAIVAEARRRGIAIPPAKDFRAVPGCGVHALVGNDFVEIASPQSYRGAPLAELAPLLSAGATAAIVL
LDGVAIGVLGLTDQLRPDAVESVAAMAALTAAPPVLLTGDNGRAAWRVARNAGITDVRAALLPEQKVEVVRNLQAG
GHQVLLVGDGVNDAPAMAAARAAVAMGAGADLTLQTADGVTIRDELHTIPTIIGLARQARRVVTVNLAIAATFIAVLV
LWDLFGQLPLPLGVVGHEGSTVLVALNGMRLLTNRSWRAAASAAR (SEQ ID NO: 28)

DNA Sequence

SEQ ID NO: 25 - TGCGCGGTGGTGCTGGCCACCATGCCGCCGCTGCTTTCGGCGATCGCC

AACGCA

>MT1515

ATGACCTTGACCGCTTGTGAAGTAACTGCCGCGGAGGCTCCTTTCGACCGCGTTTCAAAGACCATTCCCCACC
CATTGAGCTGGGGAGCCGCGCTGTGGTCGGTAGTCTCCGTGCGCTGGGCCACCGTGGCGCTGCTGCTGTTT
CTCGCCGGACTAGTGGCGCAACTGAACGGTGCTCCCGAGGCCATGTGGTGGACGCTTTACCTGGCCTGTTAT
CTGGCCGGCGGCTGGGGCTCGGCATGGGCGGGCGCACAAGCGTTGCGGAACAAGGCACTTGATGTGGATCT
GCTGATGATTGCCGCGGCGGTCGGAGCGGTCGCGATTGGGCAGATCTTCGACGGCGCGCTGCTGATCGTGA
TCTTCGCCACGTCCGGTGCGCTGGATGACATTGCCACCAGACACACCGCGGAATCGGTCAAAGGCCTGCTGG
ACCTCGCGCCGGATCAGGCGGTGGTGGTCCAGGGCGACGGCAGCGAACGGGTGGTGGCGGCCAGCGAGCT
GGTGGTGGGGGACCGGGTGGTGGTGCGGCCGGGGGACCGGATACCCGCAGACGGTGCGGTGCTGTCGGG
GGCTAGCGACGTCGACCAACGCTCGATCACCGGTGAATCGATGCCGGTGGCCAAGGCCCGCGGTGACGAGG
TGTTCGCCGGCACCGTGAACGGATCGGGTGTATTGCATCTGGTGGTCACCCGTGACCCGAGCCAGACCGTG
GTAGCCCGCATCGTCGAACTGGTCGCCGACGCTTCGGCGACGAAGGCCAAAACCCAACTGTTCATTGAGAAA
ATCGAGCAACGCTACTCCCTGGGCATGGTCGCGGCCACCCTTGCCCTCATCGTTATTCCGCTGATGTTCGGC
GCCGACCTGCGGCCGGTGCTGCTGCGCGCCATGACCTTCATGATCGTGGCATCGCCATGCGCGGTGGTGCT
GGCCACCATGCCGCCGCTGCTTTCGGCGATCGCCAACGCAGGCCGTCATGGGGTGCTGGTCAAATCCGCGG
TGGTCGTCGAACGCCTGGCCGATACCAGCATCGTCGCTTTGGACAAGACCGGTACGCTGACCCGTGGCATCC
CGCGACTGGCTTCCGTCGCACCGCTGGACCCCAACGTGGTCGATGCCCGGCGATTGTTGCAATTGGCAGCT
GCCGCAGAACAATCCAGCGAGCACCCGCTTGGCCGGGCGATCGTCGCGGAAGCTCGTCGGCGTGGTATCGC
CATACCGCCCGCCAAGGACTTCCGCGCGGTCCCGGGCTGCGGGGTCCACGCCCTGGTGGGCAACGATTTCG
TCGAGATCGCCAGCCCGCAAAGCTACCGCGGTGCACCGCTAGCAGAGCTGGCGCCGCTCCTTTCTGCCGGC
GCCACTGCCGCCATCGTCTTGTTGGATGGAGTTGCCATCGGTGTGCTCGGGCTCACCGATCAGCTTCGTCCG
GATGCCGTGGAGTCCGTCGCGGCGATGGCTGCATTGACCGCCGCACCACCGGTGCTGCTCACGGGTGACAA
CGGGCGAGCGGCTTGGCGGGTCGCTCGGAACGCCGGGATCACCGATGTGCGAGCCGCATTGCTGCCCGAG
CAGAAGGTTGAAGTCGTGCGCAACCTGCAGGCCGGTGGTCACCAGGTGCTGCTCGTCGGCGACGGCGTCAA
CGACGCTCCCGCCATGGCCGCCGCCCGCGCCGCTGTCGCCATGGGCGCCGGCGCCGATCTGACCCTACAG
ACCGCAGACGGGGTGACCATACGGGACGAACTGCACACCATCCCGACGATCATCGGGTTGGCACGGCAGGC
GCGCCGGGTGGTCACCGTCAACCTGGCCATCGCGGCCACCTTCATCGCCGTCCTGGTGCTGTGGGACCTTTT
TGGGCAGCTGCCGCTGCCACTGGGTGTGGTGGGTCACGAAGGGTCCACTGTGCTGGTGGCCCTCAACGGCA
TGCGGCTATTGACCAACCGGTCGTGGCGGGCCGCGGCTTCGGCTGCGCGTTAG (SEQ ID NO: 27)

Fig. 10G

| SEQ ID NO: | Sequence | TIGR annotation | Swiss-Prot | Protein Name |
|---|---|---|---|---|
| 2 | DGYVGAPAH (9mer) | MT0401 | P95197 | 5'-PHOSPHORIBOSYLGLYCINAMIDE TRANSFORMYLASE 2 |
| 6 | LAAVVGVVLAQVL (13mer) | Mb0073 | Q7U2X1 | PROBABLE GLUTAMINETRANSPORT TRANSMEMBRANE PROTEIN ABC TRANSPORTER |
| 10 | RSGAATPVR (9mer) | MT2160.1 | Q8VJQ5 | HYPOTHETICA PROTEIN |
| 14 | TCLPFAL (7mer) | MT0910.2 | Q8VKC1 | HYPOTHETICAL PROTEIN |
| 18 | TTMPLFAD (8mer) | Mb1654c | Q7TZV3 | HYPOTHETICAL PROTEIN |
| 22 | VLVALAALGTQPWQDFAEQETAGLAIILDNV THGEWASTILAAGAVV (47mer) | Mb2347c | Q7TYU0 | PROBABLE CATIONIC AMINO ACID TRANSPORT INTEGRAL MEMBRANE PROTEIN ROCE |
| 26 | CAVVLATMPPLLSAIANA (8mer) | Mb1504 | O53160 | PROBABLE CATIONTRANSPORTING PTYPE ATPASE D |

Fig. 10H

Protein and DNA sequences of TB peptide found in urine of TB patient:

Protein Sequence

SEQ ID NO: 30 - MVIIELMRR

>MT1721
MVIIELMRRVVGLAQGATAEVAVYGDRDRDLAERWCANTGNTLVRADVDQTGVGTLVVRR
GHPPDPASVLGPDRLPGVRLWLYTNFHCNLCCDYCCVSSSPSTPHRELGAERIGRIVGEA
ARWGVRELFLTGGEPFLLPDIDTIIATCVKQLPTTVLTNGMVFKGRGRRALESLPRGLAL
QISLDSATPELHDAHRGAGTWVKAVAGIRLALSLGFRVRVAATVASPAPGELTAFHDFLD
GLGIAPGDQLVRPIALEGAASQGVALTRESLVPEVTVTADGVYWHPVAATDERALVTRTV
EPLTPALDMVSRLFAEQWTRAAEEAALFPCA (SEQ ID NO: 32)

DNA Sequence

SEQ ID NO: 29 - ATGGTGATCATAGAGCTGATGCGCCGG

>MT1721
ATGGTGATCATAGAGCTGATGCGCCGGGTGGTAGGTCTCGCACAGGGAGCTACCGCCGAG
GTCGCCGTCTATGGCGACCGAGATCGTGATCTCGCGGAGCGATGGTGCGCGAACACCGGA
AACACCCTGGTGCGCGCCGACGTGGACCAGACCGGCGTCGGCACCCTGGTGGTGCGCCGC
GGCCATCCGCCTGACCCGGCAAGCGTGTTGGGCCCCGACCGGCTACCCGGGGTCCGGTTG
TGGCTGTACACCAACTTCCACTGCAACCTGTGCTGCGACTACTGCTGCGTCTCGTCGTCA
CCAAGCACCCCGCATCGCGAACTGGGGGCGGAGCGGATCGGCCGAATCGTCGGTGAAGCG
GCGCGCTGGGGAGTGCGCGAACTGTTCCTCACCGGCGGTGAGCCGTTCCTGCTGCCCGAC
ATCGACACGATCATCGCGACCTGTGTGAAGCAGTTGCCCACCACCGTCCTCACCAACGGC
ATGGTGTTCAAAGGGCGGGGTCGGCGCGCGCTGGAATCCCTACCTAGAGGGCTCGCCTTG
CAGATCAGCCTGGACTCGGCCACCCCGGAGCTGCACGATGCGCACCGCGGCGCGGGGACG
TGGGTCAAGGCAGTAGCTGGTATCCGGTTGGCGCTCTCACTTGGCTTCCGGGTGCGGGTG
GCCGCGACGGTTGCCAGCCCCGCACCTGGCGAGCTGACGGCGTTTCACGACTTCCTCGAC
GGGCTTGGCATCGCACCCGGGGATCAGCTGGTCCGGCCGATCGCGCTGGAGGGCGCCGCG
TCGCAAGGGGTGGCGCTCACCCGCGAATCGCTGGTTCCCGAGGTGACCGTCACCGCCGAC
GGCGTGTACTGGCACCCAGTGGCCGCCACCGACGAGCGCGCCCTGGTCACCCGTACCGTC
GAACCCTTGACCCCGGCGCTGGACATGGTAAGCCGGCTATTCGCCGAACAGTGGACACGA
GCCGCCGAAGAGGCCGCGTTGTTCCCGTGTGCGTAG (SEQ ID NO: 31)

Fig. 11

*Mycobacterium tuberculosis* peptides found in the urine of patients with pulmonary tuberculosis

| SEQ ID NO: | Peptide | *M. tuberculosis* donor protein |
|---|---|---|
| 34 | RATADQIGTQTTQIAAIKA | Homoserine O-acetyltransferase |
| 38 | RTAEERANAVRGRADSLRR | Chromosome partition protein smc |
| 42 | RLHAQKALLVWLLERS | Ornithine carbamoyltransferase |
| 46 | RWTDETFGDIGGAGGGVSGHRG | Phosphoadenosine phosphosulfate reductase |

Fig. 12

Protein: Homoserine O-acetyltransferase

Peptide: RATADQIGTQTTQIAAIKA (SEQ ID NO: 34)

| TIGR Annotation for MT3444 | |
|---|---|
| **TIGR Locus Name:** | **MT3444** |
| **Primary Locus Name:** | **None** |
| **SWISS-PROT/TrEMBL AC:** | **O53391** |
| **Putative identification:** | homoserine O-acetyltransferase |
| **Gene Symbol:** | metA |
| **TIGR Cellular role(s):** | Amino acid biosynthesis: Aspartate family |
| **Coordinates:** | 3725096 to 3726235 |
| **DNA Molecule Name:** | chromosome Mycobacterium tuberculosis CDC1551 |
| **Gene length:** | 1140 |
| **Protein length:** | 379 |
| **Molecular Weight:** | 39798.68 |
| **pI:** | 5.3912 |
| **Percent GC:** | 69.31% |
| **Enzyme Commission #:** | 2.3.1.31 |
| **Kingdom:** | Bacteria |
| **Family:** | Actinobacteria |

Fig. 13A

Protein Sequence

SEQ ID NO: 34 - RATADQIGTQTTQIAAIKA

>MT3444
MTISDVPTQTLPAEGEIGLIDVGSLQLESGAVIDDVCIAVQRWGKLSPARDNVVVVLHAL
TGDSHITGPAGPGHPTPGWWDGVAGPSAPIDTTRWCAVATNVLGGCRGSTGPSSLARDGK
PWGSRFPLISIRDQVQADVAALAALGITEVAAVVGGSMGGARALEWVVGYPDRVRAGLLL
AVGARATADQIGTQTTQIAAIKADPDWQSGDYHETGRAPDAGLRLARRFAHLTYRGEIEL
DTRFANHNQGNEDPTAGGRYAVQSYLEHQGDKLLSRFDAGSYVILTEALNSHDVGRGRGG
VSAALRACPVPVVVGGITSDRLYPLRLQQELADLLPGCAGLRVVESVYGHDGFLVETEAV
GELIRQTLGLADREGACRR (SEQ ID NO: 36)

DNA Sequence

SEQ ID NO: 33 -
**CGTGCCACCGCAGACCAGATCGGCACGCAGACAACGCAAATCGCGGCC
ATCAAAGCC**

>MT3444
ATGACGATCTCCGATGTACCCACCCAGACGCTGCCCGCCGAAGGCGAAATCGGCCTGATA
GACGTCGGCTCGCTGCAACTGGAAAGCGGGGCGGTGATCGACGATGTCTGTATCGCCGTG
CAACGCTGGGGCAAATTGTCGCCCGCACGGGACAACGTGGTGGTGGTCTTGCACGCGCTC
ACCGGCGACTCGCACATCACTGGACCCGCCGGACCCGGCCACCCCACCCCCGGCTGGTGG
GACGGGGTGGCCGGGCCGAGTGCGCCGATTGACACCACCCGCTGGTGCGCGGTAGCTACC
AATGTGCTCGGCGGCTGCCGCGGCTCCACCGGGCCCAGCTCGCTTGCCCGCGACGGAAAG
CCTTGGGGCTCAAGATTTCCGCTGATCTCGATACGTGACCAGGTGCAGGCGGACGTCGCG
GCGCTGGCCGCGCTGGGCATCACCGAGGTCGCCGCCGTCGTCGGCGGCTCCATGGGCGGC
GCCCGGGCCCTGGAATGGGTGGTCGGCTACCCGGATCGGGTCCGAGCCGGATTGCTGCTG
GCGGTCGGTGCG**CGTGCCACCGCAGACCAGATCGGCACGCAGACAACGCAAATCGCGGCC
ATCAAAGCC**GACCCGGACTGGCAGAGCGGCGACTACCACGAGACGGGGAGGGCACCAGAC
GCCGGGCTGCGACTCGCCCGCCGCTTCGCGCACCTCACCTACCGCGGCGAGATCGAGCTC
GACACCCGGTTCGCCAACCACAACCAGGGCAACGAGGATCCGACGGCCGGCGGGCGCTAC
GCGGTGCAAAGTTATCTGGAACACCAAGGAGACAAACTGTTATCCCGGTTCGACGCCGGC
AGCTACGTGATTCTCACCGAGGCGCTCAACAGCCACGACGTCGGCCGCGGCCGCGGCGGG
GTCTCCGCGGCTCTGCGCGCCTGCCCGGTGCCGGTGGTGGTGGGCGGCATCACCTCCGAC
CGGCTCTACCCGCTGCGCCTGCAGCAGGAGCTGGCCGACCTGCTGCCGGGCTGCGCCGGG
CTGCGAGTCGTCGAGTCGGTCTACGGACACGACGGCTTCCTGGTGGAAACCGAGGCCGTG
GGCGAATTGATCCGCCAGACACTGGGATTGGCTGATCGTGAAGGCGCGTGTCGGCGGTGA
(SEQ ID NO: 35)

Fig. 13B

Protein: Chromosome partition protein smc

Peptide: RTAEERANAVRGRADSLRR (SEQ ID NO: 38)

| TIGR Annotation for MT2990 | |
|---|---|
| TIGR Locus Name: | MT2990 |
| Primary Locus Name: | None |
| SWISS-PROT/TrEMBL AC: | Q10970 |
| Putative identification: | chromosome segregation SMC protein, putative |
| TIGR Cellular role(s): | Cellular processes: Cell division |
| Coordinates: | 3232127 to 3228510 |
| DNA Molecule Name: | chromosome Mycobacterium tuberculosis CDC1551 |
| Gene length: | 3618 |
| Protein length: | 1205 |
| Molecular Weight: | 130637.03 |
| pI: | 4.9064 |
| Percent GC: | 67.28% |
| Kingdom: | Bacteria |
| Family: | Actinobacteria |

FIG. 14A

Protein Sequence

SEQ ID NO: 38 - RTAEERANAVRGRADSLRR

>MT2990
MYLKSLTLKGFKSFAAPTTLRFEPGITAVVGPNGSGKSNVVDALAWVMGEQGAKTLRGGK
MEDVIFAGTSSRAPLGRAEVTVSIDNSDNALPIEYTEVSITRRMFRDGASEYEINGSSCR
LMDVQELLSDSGIGREMHVIVGQGKLEEILQSRPEDRRAFIEEAAGVLKHRKRKEKALRK
LDTMAANLARLTDLTTELRRQLKPLGRQAEAAQRAAAIQADLRDARLRLAADDLVSRRAE
REAVFQAEAAMRREHDEAAARLAVASEELAAHESAVAELSTRAESIQHTWFGLSALAERV
DATVRIASERAHHLDIEPVAVSDTDPRKPEELEAEAQQVAVAEQQLLAELDAARARLDAA
RAELADRERRAAEADRAHLAAVREEADRREGLARLAGQVETMRARVESIDESVARLSERI
EDAAMRAQQTRAEFETVQGRIGELDQGEVGLDEHHERTVAALRLADERVAELQSAERAAE
RQVASLRARIDALAVGLQRKDGAAWLAHNRSGAGLFGSIAQLVKVRSGYEAALAAALGPA
ADALAVDGLTAAGSAVSALKQADGGRAVLVLSDWPAPQAPQSASGEMLPSGAQWALDLVE
SPPQLVGAMIAMLSGVAVVNDLTEAMGLVEIRPELRAVTVDGDLVGAGWVSGGSDRKLST
LEVTSEIDKARSELAAAEALAAQLNAALAGALTEQSARQDAAEQALAALNESDTAISAMY
EQLGRLGQEARAAEEEWNRLLQQRTEQEAVRTQTLDDVIQLETQLRKAQETQRVQVAQPI
DRQAISAAADRARGVEVEARLAVRTAEERANAVRGRADSLRRAAAAEREARVRAQQARAA
RLHAAAVAAAVADCGRLLAGRLHRAVDGASQLRDASAAQRQQRLAAMAAVRDEVNTLSAR
VGELTDSLHRDELANAQAALRIEQLEQMVLEQFGMAPADLITEYGPHVALPPTELEMAEF
EQARERGEQVIAPAPMPFDRVTQERRAKRAERALAELGRVNPLALEEFAALEERYNFLST
QLEDVKAARKDLLGVVADVDARILQVFNDAFVDVEREFRGVFTALFPGGEGRLRLTEPDD
MLTTGIEVEARPPGKKITRLSLLSGGEKALTAVAMLVAIFRARPSPFYIMDEVEAALDDV
NLRRLLSLFEQLREQSQIIIITHQKPTMEVADALYGVTMQNDGITAVISQRMRGQQVDQL
VTNSS (SEQ ID NO: 40)

DNA Sequence

SEQ ID NO: 37 -
**CGCACCGCCGAGGAACGCGCCAACGCGGTTCGCGGGCGGGCCGATTCGCTG
CGCCGT**
>MT2990
GTGTACCTCAAGAGTCTGACGTTGAAGGGCTTCAAGTCCTTCGCCGCGCCGACGACTTTA
CGCTTCGAGCCGGGCATTACGGCCGTCGTTGGGCCCAACGGCTCCGGCAAATCCAATGTG
GTCGATGCCCTGGCGTGGGTGATGGGGGAGCAGGGGGCAAAGACGCTGCGCGGCGGCAAG
ATGGAAGACGTCATCTTCGCCGGCACCTCGTCGCGTGCGCCGCTGGGCCGCGCCGAAGTC
ACCGTTAGCATCGACAACTCCGACAACGCACTGCCTATCGAATACACCGAGGTGTCGATC
ACCCGAAGAATGTTTCGCGACGGTGCCAGCGAATACGAAATCAACGGCAGCAGTTGCCGT
TTGATGGATGTGCAGGAGTTGCTGAGCGACTCCGGCATCGGCCGTGAGATGCATGTGATT
GTTGGGCAAGGGAAGCTCGAGGAGATCTTGCAGTCGCGGCCTGAGGATCGGCGGGCGTTC
ATCGAGGAAGCCGCCGGTGTGCTCAAGCATCGCAAGCGCAAGGAAAAAGCTCTGCGCAAA
CTCGACACGATGGCGGCGAACCTGGCCCGGCTCACCGATCTGACCACCGAGCTCCGGCGT
CAACTCAAACCGCTGGGCCGGCAGGCCGAGGCGGCCCAGCGTGCCGCGGCCATCCAAGCC
GATCTGCGCGACGCCCGGCTGCGCCTGGCGGCCGACGACTTGGTAAGCCGCAGAGCCGAA
CGGGAAGCGGTCTTTCAGGCCGAGGCTGCGATGCGCCGCGAGCATGACGAGGCCGCCGCC
CGGCTGGCGGTGGCATCCGAGGAGCTGGCCGCGCATGAGTCCGCGGTCGCCGAACTCTCG
ACGCGGGCCGAGTCGATCCAGCACACTTGGTTCGGGCTGTCTGCGCTGGCCGAACGGGTG
GACGCTACGGTGCGCATCGCCAGCGAACGCGCCCATCATCTCGATATCGAGCCGGTAGCG

FIG. 14B

GTCAGCGACACCGACCCCAGAAAGCCCGAGGAGCTAGAAGCCGAGGCCCAGCAGGTGGCC
GTCGCCGAGCAACAACTGTTAGCGGAGCTGGACGCGGCGCGTGCCCGACTCGATGCTGCC
CGTGCAGAGCTGGCCGACCGGGAGCGCCGCGCCGCCGAGGCCGACCGGGCACACCTGGCG
GCGGTCCGGGAGGAGGCGGACCGCCGTGAGGGACTGGCGCGGCTGGCTGGCCAGGTGGAG
ACCATGCGGGCGCGTGTCGAATCGATCGATGAGAGCGTGGCACGGTTGTCCGAGCGGATC
GAGGATGCCGCAATGCGCGCCCAGCAGACCCGAGCCGAGTTCGAAACCGTGCAGGGCCGC
ATCGGTGAACTGGATCAAGGCGAGGTCGGCCTGGATGAGCACCACGAGCGTACTGTGGCC
GCGTTGCGGTTGGCCGACGAACGCGTCGCCGAGCTGCAATCCGCCGAACGCGCCGCCGAA
CGCCAGGTGGCATCGCTACGGGCTCGCATCGATGCGCTCGCAGTGGGGCTACAGCGCAAG
GACGGCGCGGCGTGGCTGGCGCACAATCGCAGTGGCGCAGGGCTTTTCGGTTCGATCGCC
CAATTGGTGAAGGTACGTTCCGGCTATGAAGCGGCACTGGCCGCGGCGCTCGGGCCGGCG
GCCGACGCACTTGCGGTGGACGGCCTGACTGCCGCGGGTAGTGCCGTCAGCGCACTCAAA
CAAGCCGACGGCGGTCGCGCGGTCCTCGTGCTGAGTGACTGGCCGGCCCCGCAAGCCCCC
CAATCCGCCTCGGGGGAGATGCTGCCTAGCGGCGCCCAGTGGGCCCTAGACCTGGTCGAG
TCTCCACCGCAGTTGGTTGGCGCGATGATCGCCATGCTTTCGGGTGTCGCGGTGGTCAAC
GACCTGACTGAGGCAATGGGCCTGGTCGAGATTCGTCCGGAGCTACGCGCGGTCACCGTT
GACGGTGATCTGGTGGGCGCCGGCTGGGTCAGCGGCGGATCGGACCGCAAGCTGTCCACC
TTGGAGGTCACCTCCGAGATCGACAAGGCCAGGAGTGAGCTGGCCGCTGCCGAGGCGCTG
GCGGCGCAATTGAATGCGGCCCTGGCCGGTGCGCTGACCGAGCAGTCCGCCCGCCAGGAC
GCGGCCGAGCAAGCCTTGGCCGCGCTTAACGAATCCGACACGGCCATCTCGGCGATGTAC
GAGCAGCTGGGCCGCCTCGGGCAGGAGGCCCGCGCGGCGGAAGAAGAGTGGAACCGGTTG
CTGCAGCAGCGTACGGAACAGGAAGCCGTGCGCACACAGACTCTCGACGACGTCATACAA
CTTGAGACCCAGCTGCGTAAGGCCCAGGAGACCCAACGGGTGCAGGTGGCCCAACCGATC
GACCGCCAGGCGATCAGTGCCGCTGCCGATCGCGCCCGCGGTGTCGAAGTGGAAGCCCGG
CTGGCGGTGCGCACCGCCGAGGAACGCGCCAACGCGGTTCGCGGGCGGGCCGATTCGCTG
CGCCGTGCGGCAGCGGCGGAACGTGAGGCGCGGGTGCGGGCTCAGCAAGCACGCGCCGCA
AGACTGCATGCGGCCGCGGTGGCCGCAGCGGTCGCCGACTGCGGACGGCTGCTGGCCGGG
CGGTTGCACCGGGCGGTGGACGGGGCGTCGCAACTGCGCGACGCGTCGGCCGCGCAACGT
CAGCAGCGGTTAGCGGCGATGGCCGCGGTGCGCGACGAGGTGAACACGCTGAGCGCCCGA
GTGGGGGAACTCACCGATTCGCTGCACCGCGACGAGCTGGCTAACGCGCAGGCGGCGCTG
CGTATCGAGCAGCTTGAGCAGATGGTGCTAGAGCAGTTCGGAATGGCGCCGGCCGACTTG
ATCACCGAATACGGTCCACATGTGGCGCTACCACCGACCGAGCTCGAGATGGCTGAGTTC
GAGCAAGCCCGCGAACGCGGCGAGCAGGTGATTGCGCCCGCCCCCATGCCGTTCGACCGG
GTTACCCAGGAGCGCCGGGCCAAACGCGCCGAGCGTGCGCTTGCCGAGTTGGGCAGGGTC
AACCCGCTGGCGCTCGAAGAGTTTGCTGCCTTGGAGGAGCGCTACAATTTCCTGTCCACC
CAACTCGAGGATGTCAAGGCTGCCCGCAAGGATCTGCTGGGCGTCGTCGCCGATGTTGAC
GCCCGCATCCTGCAGGTGTTCAATGACGCGTTCGTAGACGTGGAACGCGAATTTCGCGGC
GTGTTCACCGCATTGTTCCCCGGTGGTGAAGGACGGCTGCGGCTGACCGAGCCCGACGAC
ATGCTCACCACCGGCATCGAGGTCGAAGCCCGCCCGCCGGGCAAGAAGATTACCCGACTG
TCTTTGCTCTCCGGTGGCGAGAAGGCGCTGACCGCGGTGGCGATGCTGGTCGCGATCTTT
CGTGCCCGTCCATCGCCGTTCTACATCATGGACGAGGTGGAGGCCGCCCTCGACGACGTG
AACCTGCGCCGACTGCTCAGCCTGTTCGAACAGCTGCGAGAGCAGTCGCAGATCATCATC
ATCACCCACCAGAAGCCGACGATGGAGGTCGCGGACGCACTGTACGGCGTAACCATGCAG
AACGACGGCATCACCGCGGTCATCTCGCAGCGCATGCGCGGTCAGCAGGTGGATCAGCTG
GTTACCAATTCCTCGTAG (SEQ ID NO: 39)

FIG. 14C

Protein: Ornithine carbamoyltransferase

Peptide: RLHAQKALLVWLLERS (SEQ ID NO: 42)

| TIGR Annotation for MT1694 | |
|---|---|
| TIGR Locus Name: | MT1694 |
| Primary Locus Name: | None |
| SWISS-PROT/TrEMBL AC: | P94991 |
| Putative identification: | ornithine carbamoyltransferase |
| Gene Symbol: | argF |
| TIGR Cellular role(s): | Amino acid biosynthesis: Glutamate family |
| Coordinates: | 1860829 to 1861752 |
| DNA Molecule Name: | chromosome Mycobacterium tuberculosis CDC1551 |
| Gene length: | 924 |
| Protein length: | 307 |
| Molecular Weight: | 33057.22 |
| pI: | 5.0574 |
| Percent GC: | 68.95% |
| Enzyme Commission #: | 2.1.3.3 |
| Kingdom: | Bacteria |
| Family: | Actinobacteria |

FIG. 15A

Protein Sequence

SEQ ID NO: 42 - RLHAQKALLVWLLERS

>MT1694
MIRHFLRDDDLSPAEQAEVLELAAELKKDPVSRRPLQGPRGVAVIFDKNSTRTRFSFELG
IAQLGGHAVVVDSGSTQLGRDETLQDTAKVLSRYVDAIVWRTFGQERLDAMASVATVPVI
NALSDEFHPCQVLADLQTIAERKGALRGLRLSYFGDGANNMAHSLLLGGVTAGIHVTVAA
PEGFLPDPSVRAAAERRAQDTGASVTVTADAHAAAAGADVLVTDTWTSMGQENDGLDRVK
PFRPFQLNSRLLALADSDAIVLHCLPAHRGDEITDAVMDGPASAVWDEAENRLHAQKALL
VWLLERS (SEQ ID NO: 44)

DNA Sequence

SEQ ID NO: 41 - CTGCACGCGCAGAAGGCGCTGCTGGTGTGGCTGCTGGAGCGCTCATGA

>MT1694
GTGATCAGGCATTTCCTGCGCGACGACGATCTGTCCCCGGCCGAACAGGCCGAGGTGCTC
GAGCTCGCGGCCGAGCTGAAGAAAGACCCGGTTAGCCGTCGTCCCCTGCAAGGGCCGCGC
GGGGTGGCGGTCATCTTCGACAAGAACTCCACCCGCACCCGGTTCTCCTTCGAGCTGGGC
ATCGCGCAGCTGGGCGGGCATGCCGTCGTCGTCGACAGCGGCAGCACCCAGCTGGGCCGC
GACGAAACCCTGCAGGACACCGCAAAGGTGTTGTCCCGCTACGTCGATGCCATCGTCTGG
CGAACCTTCGGCCAAGAGCGGCTGGACGCCATGGCGTCGGTCGCGACGGTGCCCGTGATC
AACGCGCTCTCCGATGAGTTCCATCCGTGTCAGGTGTTGGCCGACCTGCAGACCATCGCC
GAACGCAAGGGGGCGCTGCGCGGCCTGAGGTTGTCCTACTTCGGCGACGGCGCCAACAAC
ATGGCCCACTCGCTGCTGCTCGGCGGGGTCACCGCGGGTATCCACGTCACCGTCGCGGCT
CCCGAGGGCTTCCTGCCCGACCCGTCGGTGCGGGCCGCGGCCGAGCGCCGCGCCCAGGAT
ACCGGCGCCTCGGTGACTGTGACCGCCGACGCCCACGCGGCCGCCGCCGGCGCCGACGTT
CTGGTCACCGACACCTGGACGTCGATGGGCCAGGAAAACGACGGGTTGGACCGAGTGAAG
CCGTTTCGGCCGTTTCAGCTCAACTCGCGACTTCTGGCGCTGGCCGACTCGGATGCCATC
GTGTTGCATTGCCTGCCGGCCCATCGCGGCGACGAGATCACCGACGCGGTGATGGACGGG
CCGGCCAGCGCGGTGTGGGACGAGGCCGAAAACCGGCTGCACGCGCAGAAGGCGCTGCTG
GTGTGGCTGCTGGAGCGCTCATGA (SEQ ID NO: 43)

FIG. 15B

Protein: Probable phosphoadenosine phosphosulfate reductase

Peptide: RWTDETFGDIGGAGGGVSGHRG (SEQ ID NO: 46)

| TIGR Annotation for MT2462 | |
|---|---|
| **TIGR Locus Name:** | **MT2462** |
| **Primary Locus Name:** | **None** |
| **SWISS-PROT/TrEMBL AC:** | **P71752** |
| **Putative identification:** | phosphoadenosine phosphosulfate reductase |
| **Gene Symbol:** | cysH |
| **TIGR Cellular role(s):** | Amino acid biosynthesis: Serine family<br>Central intermediary metabolism: Sulfur metabolism |
| **Coordinates:** | 2683698 to 2684462 |
| **DNA Molecule Name:** | chromosome Mycobacterium tuberculosis CDC1551 |
| **Gene length:** | 765 |
| **Protein length:** | 254 |
| **Molecular Weight:** | 27422.87 |
| **pI:** | 4.9994 |
| **Percent GC:** | 64.30% |
| **Enzyme Commission #:** | 1.8.99.4 |
| **Kingdom:** | Bacteria |
| **Family:** | Actinobacteria |

FIG. 16A

Protein Sequence

SEQ ID NO: 46 - RWTDETFGDIGGAGGGVSGHRG

>MT2462
MSGETTRLTEPQLRELAARGAAELDGATATDMLRWTDETFGDIGGAGGGVSGHRGWTTCN
YVVASNMADAVLVDLAAKVRPGVPVIFLDTGYHFVETIGTRDAIESVYDVRVLNVTPEHT
VAEQDELLGKDLFARNPHECCRLRKVVPLGKTLRGYSAWVTGLRRVDAPTRANAPLVSFD
ETFKLVKVNPLAAWTDQDVQEYIADNDVLVNPLVREGYPSIGCAPCTAKPAEGADPRSGR
WQGLAKTECGLHAS (SEQ ID NO: 48)

DNA Sequence

SEQ ID NO: 45 - **CGCTGGACCGACGAAACCTTCGGCGACATCGGCGGCGCC
GGCGGCGGCGTGAGCGGACATCGCGGG**

>MT2462
ATGAGCGGCGAGACAACCAGGCTGACCGAACCGCAACTACGTGAGCTGGCCGCGCGCGGA
GCTGCCGAACTCGACGGCGCCACCGCCACCGACATGTTG**CGCTGGACCGACGAAACCTTC
GGCGACATCGGCGGCGCCGGCGGCGGCGTGAGCGGACATCGCGGG**TGGACAACGTGCAAC
TACGTAGTTGCTTCCAACATGGCTGATGCGGTGCTGGTGGATCTGGCCGCCAAGGTGCGA
CCGGGCGTACCGGTCATCTTTCTTGATACCGGCTACCACTTCGTCGAAACAATCGGCACC
AGAGATGCGATCGAGTCCGTCTATGACGTCCGGGTGCTCAATGTCACTCCGGAGCACACA
GTGGCCGAGCAGGACGAACTGCTGGGCAAGGACTTGTTCGCCCGCAACCCCCATGAATGC
TGCCGGTTGCGCAAGGTCGTTCCCCTGGGCAAGACGCTGCGTGGCTACTCCGCGTGGGTG
ACCGGGCTACGGCGGGTCGATGCACCGACCCGGGCCAATGCCCCGCTGGTCAGCTTCGAT
GAGACGTTCAAACTAGTGAAGGTCAACCCGCTGGCGGCGTGGACCGACCAAGATGTGCAG
GAATACATTGCCGACAACGACGTGCTGGTTAATCCGCTTGTGCGGGAAGGCTATCCGTCG
ATCGGTTGCGCTCCGTGCACAGCCAAACCCGCCGAAGGCGCCGACCCGCGCAGCGGACGC
TGGCAGGGGCTGGCCAAGACCGAATGCGGGTTGCACGCCTCGTGA (SEQ ID NO:47)

FIG. 16B

The following is the nucleotide sequence of 85b antigen fused to the pulA signal peptide.

```
1    ATGGTCTACA GCATCCGTTC CCTCAAAAAT GGAACTGGTT CTGTCCTTAT
51   TGGAGCAAGC CTTATTCTGC TTGCCATGGC TACACCAACT ATCTCAGCAA
101  ACGAAAATAC ACCAACCACT AACGAACCCA GCAACAGAAA TACGACCTCC
151  CTTACTCAAC CTCTTACTGA TGCAACAAAC ATCGCTGGCA AGAACGAAAG
201  CGATTTTTCT TCACCCGATA GTGCAAACGC TTCCATGACA GACGTTTCTA
251  GAAAAATTCG TGCTTGGGGA AGACGTTTAA TGATTGGAAC CGCTGCTGCC
301  GTTGTTTTAC CTGGACTCGT TGGATTAGCC GGTGGCGCCG CTACAGCCGG
351  AGCTTTTTCT CGTCCTGGTT TGCCTGTTGA ATATTTACAA GTTCCTTCTC
401  CATCTATGGG TCGCGATATC AAAGTACAAT TTCAGTCTGG TGGCAATAAC
451  TCTCCTGCCG TTTACTTACT CGATGGTCTC CGTGCACAAG ACGATTACAA
501  TGGTTGGGAC ATTAATACTC CTGCATTTGA ATGGTACTAT CAGTCAGGTC
551  TCTCAATCGT AATGCCTGTC GGTGGTCAAA GTAGTTTTTA TTCTGATTGG
601  TACTCACCTG CCTGTGGAAA AGCAGGATGT CAAACTTACA AATGGGAAAC
651  ATTCTTAACT TCAGAGCTTC CACAATGGTT ATCCGCAAAT CGAGCTGTTA
701  AACCTACTGG GTCTGCTGCT ATTGGTCTAT CTATGGCTGG TTCTTCCGCA
751  ATGATCTTAG CTGCTTATCA TCCACAACAA TTTATTTATG CTGGCTCACT
801  ATCTGCTCTT CTAGATCCTT CTCAAGGTAT GGGACCAAGT TTAATTGGAT
851  TAGCTATGGG CGACGCTGGA GGTTACAAAG CTGCCAATAT GTGGGGACCT
901  TCTTCTGATC CTGCCTGGGA ACGAAATGAT CCAACACAAC AAATTCCAAA
951  ATTAGTAGCA AATAACACAC GTTTATGGGT TTACTGTGGT AATGGCACAC
1001 CAAATGAACT TGGAGGGGCT AACATTCCTG CTGAATTCTT AAAAAATTTT
1051 GTTAGAAGCT CAAACTTAAA ATTTCAAGAC GCATATAACG CAGCTGGAGG
1101 GCATAATGCT GTATTTAATT TTCCTCCAAA CGGAACACAT TCATGGGAAT
1151 ATTGGGGCGC ACAATTAAAT GCTATGAAAG GAGATTTACA AAGTTCACTA
1201   TGCTGGTT AA (SEQ ID NO: 53)
```

Fig. 17A

The following is the amino of 85b antigen fused to the pulA signal peptide.

```
        10          20          30          40          50          60
MVYSIRSLKN  GTGSVLIGAS  LILLAMATPT  ISANENTPTT  NEPSNRNTTS  LTQPLTDATN

        70          80          90         100         110         120
IAGKNESDFS  SPDSANASNE  LFSRPGLPVE  YLQVPSPSMG  RDIKVQFQSG  GNNSPAVYLL

       130         140         150         160         170         180
DGLRAQDDYN  GWDINTPAFE  WYYQSGLSIV  MPVGGQSSFY  SDWYSPACGK  AGCQTYKWET

       190         200         210         220         230         240
FLTSELPQWL  SANRAVKPTG  SAAIGLSMAG  SSAMILAAYH  PQQFIYAGSL  SALLDPSQGM

       250         260         270         280         290         300
GPSLIGLAMG  DAGGYKAANM  WGPSSDPAWE  RNDPTQQIPK  LVANNTRLWV  YCGNGTPNEL

       310         320         330         340         350         360
GGANIPAEFL  KNFVRSSNLK  FQDAYNAAGG  HNAVFNFPPN  GTHSWEYWGA  QLNAMKGDLQ

SSLGAG (SEQ ID NO: 54)
```

Fig. 17B

The nucleotide sequence for pula-HIVgp120 fusion protein:

```
   1  ATGGTCTACA GCATCCGTTC CCTCAAAAAT GGAACTGGTT CTGTCCTTAT
  51  TGGAGCAAGC CTTATTCTGC TTGCCATGGC TACACCAACT ATCTCAGCAA
 101  ACGAAAATAC ACCAACCACT AACGAACCCA GCAACAGAAA TACGACCTCC
 151  CTTACTCAAC CTCTTACTGA TGCAACAAAC ATCGCTGGCA AGAACGAAAG
 201  CGATTTTTCT TCACCCGATA GTGCAAACGC TTCCGCAACT ACAACCCTTT
 251  TTTGCGCTTC AGACGCCAAA GCTTACGATA CTGAAGTCCA TAATGTCTGG
 301  GCTACGCATG CCTGTGTACC TACTGACCCT AACCCACAAG AAGTCGTACT
 351  AGTAAATGTC ACCGAGAATT TCAATATGTG GAAGAATGAT ATGGTGGAGC
 401  AAATGCACGA AGATATCATC AGTTTATGGG ATCAAAGCTT AAAACCTTGT
 451  GTCAAACTCA CCCCATTATG TGTCTCTCTC AAATGCACAG ATCTAAAAAA
 501  CGATACCAAC ACTAACTCAT CATCTGGAAG AATGATTATG GAAAAAGGAG
 551  AAATTAAAAA TTGTAGTTTT AACATCAGCA CATCTATTCG CGGTAAAGTA
 601  CAAAAAGAAT ACGCATTTTT TTATAAACTT GATATTATCC CAATCGACAA
 651  TGATACAACT AGTTACTCAC TTACGTCTTG TAATACCTCA GTCATTACCC
 701  AAGCTTGTCC AAAAGTAAGT TTTGAACCAA TTCCAATTCA TTATTGCGCA
 751  CCAGCCGGGT TTGCTATTTT AAAATGTAAT AATAAAACCT TCAATGGCAC
 801  AGGTCCTTGT ACAAATGTTT CAACCGTCCA ATGTACTCAC GGTATTCGTC
 851  CAGTCGTCAG CACACAACTC TTACTTAATG GTAGCTTAGC AGAAGAAGAG
 901  GTCGTCATCA GATCAGTTAA TTTTACAGAC AACGCAAAAA CAATCATCGT
 951  CCAGCTCAAC ACTTCAGTAG AGATTAATTG TACTAGACCT AACAACAACA
1001  CCAGAAAACG AATCCGAATC CAAAGAGGGC CAGGACGCGC CTTTGTTACG
1051  ATCGGTAAAA TCGGAAATAT GAGACAAGCT CATTGCAATA TTAGTAGAGC
1101  AAAATGGAAC AATACCCTTA AACAAATCGC TTCTAAGTTA AGAGAACAGT
1151  TTGGTAACAA TAAAACCATT ATTTTTAAAC AATCATCAGG CGGGGATCCA
1201  GAAATCGTAA CTCATTCATT TAATTGCGGA GGAGAATTTT TTTATTGTAA
1251  CTCAACACAA CTATTCAATA GCACTTGGTT TAATTCTACT TGGTCAACAG
1301  AAGGTTCAAA TAATACAGAA GGATCAGATA CAATTACATT ACCATGTCGT
1351  ATTAAGCAAA TTATTAACAT GTGGCAAAAA GTTGGAAAAG CTATGTATGC
1401  TCCTCCTATT TCAGGACAAA TTCGATGCTC TTCAAATATC ACAGGACTTT
1451  TATTAACTAG AGATGGAGGG AATTCAAATA ACGAAAGCGA GATTTTCAGA
1501  CCAGGCGGAG GAGATATGAG AGATAACTGG CGCAGTGAAT TATATAAATA
1551  CAAAGTTGTT AAAATCGAAC CATTAGGAGT AGCCCCAACC AAAGCAAAAC
1601  GTCGCGTTGT CCAATCAGAA AAGTCAGCCG TATTAGAACA ATTAGAATCA
1651  ATCATTAATT TTGAAAAACT CACAGAATGG ACCAGCTTTC TAGAACATCA
1701  TCATCATCAC CATTAA (SEQ ID NO: 51)
```

Fig. 17C

The amino acid for pula-HIVgp120 fusion protein:

```
        10         20         30         40         50         60
MVYSIRSLKN GTGSVLIGAS LILLAMATPT ISANENTPTT NEPSNRNTTS LTQPLTDATN

        70         80         90        100        110        120
IAGKNESDFS SPDSANASAT TTLFCASDAK AYDTEVHNVW ATHACVPTDP NPQEVVLVNV

       130        140        150        160        170        180
TENFNMWKND MVEQMHEDII SLWDQSLKPC VKLTPLCVSL KCTDLKNDTN TNSSSGRMIM

       190        200        210        220        230        240
EKGEIKNCSF NISTSIRGKV QKEYAFFYKL DIIPIDNDTT SYSLTSCNTS VITQACPKVS

       250        260        270        280        290        300
FEPIPIHYCA PAGFAILKCN NKTFNGTGPC TNVSTVQCTH GIRPVVSTQL LLNGSLAEEE

       310        320        330        340        350        360
VVIRSVNFTD NAKTIIVQLN TSVEINCTRP NNNTRKRIRI QRGPGRAFVT IGKIGNMRQA

       370        380        390        400        410        420
HCNISRAKWN NTLKQIASKL REQFGNNKTI IFKQSSGGDP EIVTHSFNCG GEFFYCNSTQ

       430        440        450        460        470        480
LFNSTWFNST WSTEGSNNTE GSDTITLPCR IKQIINMWQK VGKAMYAPPI SGQIRCSSNI

       490        500        510        520        530        540
TGLLLTRDGG NSNNESEIFR PGGGDMRDNW RSELYKYKVV KIEPLGVAPT KAKRRVVQSE

       550        560        570
KSAVLEQLES IINFEKLTEW TSFLEHHHHH H (SEQ ID NO: 52)
```

Fig. 17D

The nucleotide sequence for the HIV T20 36-amino acid peptide

TATACATCACTCATTCACTCACTCATCGAAGAATCACAAAATCAGCAGGAAAAAAACGAACAAGAATTATTAG
AATTAGACAAATGGGCATCACTTTGGAATTGGTTT SEQ ID NO: 49)

HIV T20 36-amino acid peptide:
YTSLIHSLIEESQNQQEKNEQELLELDKWASLWNWF (SEQ ID NO: 50)

Fig. 17E

VACCINE AND THERAPEUTIC DELIVERY SYSTEM

RELATED APPLICATIONS

This application is a continuation of Ser. No. 13/624,146 filed Sep. 21, 2012, which claims the benefit of U.S. Provisional Application No. 61/538,346 filed Sep. 23, 2011, entitled, "Mucosal Vaccination Against Infectious Diseases Delivered by Abundant Commensal Oral Bacteria" by Campos-Neto, Antonio et al. The entire contents of each of these applications are expressly incorporated herein by reference.

GOVERNMENT SUPPORT

The invention was supported, in whole or in part, by a grant R01AI076425 from National Institutes of Health-National Institute of Allergy and Infectious Disease and by a grant R01DE015931 from National Institutes of Health, National Institute of Dental and Craniofacial Research. The Government has certain rights in the invention.

SEQUENCE LISTING

The instant application contains a Sequence Listing which has been submitted via EFS-Web and is hereby incorporated by reference in its entirety. Said ASCII copy is named FIR_303_Sequence_Listing.txt and is 2,407 KB in size.

BACKGROUND OF THE INVENTION

Most immunization strategies of current vaccines use protocols that prime and boost the immune system using a parenteral route e.g., intra-dermal, sub-cutaneous and intra-muscular. These means of immunization generate strong systemic immunity but little or no mucosal immunity. In addition, this traditional vaccination protocol, despite inducing both long-lived central memory T cells and short-lived effector T cells, does not sustain a reasonable pool of the latter. These cells, which express CD4 surface antigen and recognize antigenic peptides displayed on the surface of MHC II molecules are the main orchestrators of the immune response. The short-lived T helper cells influence the function of important effector cells including CD8 cytotoxic T cells, antibody producing B lymphocytes and macrophages all of which are important in generation of a successful immune response and subsequent memory.

The primary reason for using a mucosal route of vaccination is that most infections affect or start from a mucosal surface and that in these infections, topical application of a vaccine is often required to induce a protective immune response. Examples include gastrointestinal infections caused by *Helicobacter pylori, Vibrio cholera*; enterotoxigenic infections caused by *Escherichia coli*; respiratory infections caused by *Mycobacterium tuberculosis* and *Mycoplasma pneumonia*; and sexually transmitted genital infections caused by HIV, herpes simplex virus, and *Chlamydia trachomatis*.

Therefore, a need exists for a vaccination method in which mucosal immunity is provided. Yet a further need exists for using persistent and abundant commensal oral organisms to deliver antigens for mucosal immunization against infectious diseases. Yet a further need exists for a vaccination protocol that provides generation and maintenance of a significant pool of protective effector and memory T cells.

SUMMARY OF THE INVENTION

The present invention relates to integrally transformed non-pathogenic, commensal bacterium that can express one or more nucleic acid molecules of one or more foreign polypeptides therein. The nucleic acid molecule that encodes the foreign polypeptide is stably integrated into genomic DNA of the bacterium. The commensal bacterium used in the present invention includes e.g., one or more of the following: *Streptococcus mitis, Streptococcus oxalis, Streptococcus sanguis, Streptococcus salivarius, Streptococcus constellatus, Lactobacillus casei, Lactobacillus fermenti, Veillonella parvula, Prevotella melaninogenica, Eikenella corrodens, Neisseria mucosa, Actinomyces odontolyticus, Fusobacterium periodonticum, Borrelia vincentii*, and *Actinomyces naeslundii*. The nucleic acid molecule of the foreign polypeptide includes an antigen that elicits an immunogenic response in the individual, a vaccine antigen, an inhibitor of a pathogen, an immune booster, a modulator, a composition used in the treatment of a disease or condition, or a combination thereof. Examples of vaccine antigens include *Mycobacterium leprae* antigens, *Mycobacterium tuberculosis* antigens, malaria sporozoites and merozoites, diphtheria toxoid, tetanus toxoids, Leishmania antigens, *Salmonella* antigens, *Mycobacterium africanum* antigens, *Mycobacterium intracellulare* antigens, *Mycobacterium avium* antigens, Treponema antigens, Pertussis antigens, Herpes virus antigens, Measles virus antigens, Mumps virus antigens, Shigella antigens, *Neisseria* antigens, *Borrelia* antigens, Rabies virus antigens, polio virus antigens, human immunodeficiency virus antigens, snake venom antigens, insect venom antigens, hepatitis A, B, C virus, human papilloma virus antigens, *Vibrio cholera, Candida albicans, Candida tropicalis, Paracoccidioides brasiliensis*, and the like. Examples of inhibitors of a pathogen are small, anti-microbial peptides (e.g., defensins) that can have an effect against various pathogens, including *M. tuberculosis, M. leprae, M. africanum, M. intracellulare; M. avium*; Malaria; Diphtheria; Leishmania; *Salmonella*; Treponema; Pertussis; Herpes virus; Measles virus; Mumps virus; Shigella; *Neisseria; Borrelia*; rabies virus; polio virus; Human and human immunodeficiency virus types I and II; Hepatitis A, B, C virus, *Vibrio cholera, Candida albicans, Candida tropicalis*, and *Paracoccidioides brasiliensis*, etc. Immune boosters and/or modulators include e.g., interleukins, interferons, and cytokines such as IL-1, IL-2, IL-4, IL-6, IL-8, IL-12, IL-17, IL-2 IL-21 and IL-22 and cytokines GMCSF, MCSF, MIP1alpha and beta, TNFalpha and beta, IFNalpha and beta and TGFbeta. Additionally, in an embodiment of the present invention, the nucleic acid molecule of the foreign polypeptide is transformed into a gene that expresses a polypeptide in the cytoplasm, in the cell membrane or cell wall or exports it to the cell surface of the bacterium. In one embodiment, the present invention includes utilizing *S. mitis* as the non-pathogenic, commensal bacterium, and the gene that expresses or secretes a polypeptide on the bacteria's cell surface is the serine-rich GspB homologue, the pullulanase polypeptide, or both. The present invention also embodies a foreign polypeptide that is a HIV vaccine, a tuberculosis vaccine, malaria vaccine, leishmaniasis vaccine, herpes virus vaccine, hepatitis virus vaccine, or a combination thereof. Examples of the HIV antigen that can be used with the present invention are gp120 env, gp140 env, gp160 env, gag, pol, nef, vif, vpr, vpu, tat, rev, nef or HIV T20 polypeptide inhibitor. In a particular embodiment, the present invention includes commensal bacteria that have a nucleic acid sequence that encodes the HIV T20 polypeptide, the nucleic acid sequence is set forth in SEQ ID NO: 49. The present invention also includes a commensal bacterium that encodes a foreign polypeptide that encodes the HIV T20 polypeptide according to SEQ ID NO: 50. The commensal bacterium, in an aspect, has a nucleic acid molecule that encodes HIV T20 and is inserted into a gene that expresses or secretes a pullulanase polypeptide, to thereby obtain a gene that expresses or secretes an HIV gp120/pullulanase fusion protein. The nucleic acid molecule of the HIV gp120/pullulanase fusion protein has a sequence of SEQ ID NO: 51, and encodes a sequence of SEQ ID NO: 52.

In an embodiment, the integrally transformed non-pathogenic, commensal bacterium can encode a *M. tuberculosis* antigen having a polypeptide sequence of an amino acid sequence encoded by a nucleic acid molecule. The nucleic acid molecules can be any one of the following: SEQ ID NO: 1, 3, 5, 7, 9, 11, 13, 15, 17, 19, 21, 23, 25, 27, 29, 31, 33, 35, 37, 39, 41, 43, 45, 47, or combination thereof; an amino acid sequence encoded by a coding region of a nucleic acid molecule of SEQ ID NO: 1, 3, 5, 7, 9, 11, 13, 15, 17, 19, 21, 23, 25, 27, 29, 31, 33, 35, 37, 39, 41, 43, 45, 47, or combination thereof; an amino acid sequence encoded by a complement of SEQ ID NO: 1, 3, 5, 7, 9, 11, 13, 15, 17, 19, 21, 23, 25, 27, 29, 31, 33, 35, 37, 39, 41, 43, 45, 47, or combination thereof; an amino acid sequence encoded by a nucleic acid molecule that hybridizes to SEQ ID NO: 1, 3, 5, 7, 9, 11, 13, 15, 17, 19, 21, 23, 25, 27, 29, 31, 33, 35, 37, 39, 41, 43, 45, 47, or combination thereof under high stringency conditions, wherein said conditions comprise 1×SSC, 1% SDS and 0.1-2 mg/ml denatured calf thymus DNA at 65° C.; and an amino acid sequence set forth in SEQ ID NO: 2, 4, 6, 8, 10, 12, 14, 16, 18, 20, 22, 24, 26, 28, 30, 32, 34, 36, 38, 40, 42, 44, 46, 48 or combination thereof.

In yet another embodiment, the integrally transformed non-pathogenic, commensal bacterium encodes a *M. tuberculosis* antigen. The TB antigen, for example, is encoded by one of the following nucleic acid sequences: SEQ ID NO: 1, 3, 5, 7, 9, 11, 13, 15, 17, 19, 21, 23, 25, 27, 29, 31, 33, 35, 37, 39, 41, 43, 45, 47, or combination thereof; the coding region of SEQ ID NO: 1, 3, 5, 7, 9, 11, 13, 15, 17, 19, 21, 23, 25, 27, 29, 31, 33, 35, 37, 39, 41, 43, 45, 47, or combination thereof; a complement of SEQ ID NO1, 3, 5, 7, 9, 11, 13, 15, 17, 19, 21, 23, 25, 27, 29, 31, 33, 35, 37, 39, 41, 43, 45, 47, or combination thereof; a sequence that hybridizes (e.g., under high stringency conditions) to SEQ ID NO: 1, 3, 5, 7, 9, 11, 13, 15, 17, 19, 21, 23, 25, 27, 29, 31, 33, 35, 37, 39, 41, 43, 45, 47, or combination thereof; and a sequence that encodes SEQ ID NO: 2, 4, 6, 8, 10, 12, 14, 16, 18, 20, 22, 24, 26, 28, 30, 32, 34, 36, 38, 40, 42, 44, 46, 48, or combination thereof.

The present invention also relates to integrally transformed bacterium for the delivery of a foreign polypeptide to an individual with a non-pathogenic, commensal bacterium that comprises: a genomic nucleic acid molecule; a nucleic acid molecule having a nucleic acid sequence that encodes the foreign polypeptide, wherein the nucleic acid sequence is inserted into a gene of the genomic nucleic acid molecule whose protein product is expressed in the bacterium's cytoplasm or cell wall or exported to the cell surface of the bacterium; and a nucleic acid molecule having a nucleic acid sequence for the selection of the integrally transformed bacterium. In an aspect, the nucleic acid molecule of the foreign polypeptide expresses an antigen that elicits an immunogenic response in the individual, a vaccine, an inhibitor of a pathogen, an immune booster, a composition used in the treatment of a disease or condition, or a combination thereof. The commensal bacterium can be present or inoculated in an individual in an amount between about $10\times10^3$ and about $10\times10^{10}$. In an embodiment, the bacterium is commensal to the oral cavity, the upper respiratory tract, or both.

The present invention also relates to systems for delivering, to an individual, one or more foreign polypeptides that are integrally transformed into non-pathogenic bacteria. The system includes a non-pathogenic, commensal bacterium having a genomic nucleic acid molecule; and a nucleic acid molecule having a nucleic acid sequence that encodes the foreign polypeptide, wherein the nucleic acid sequence is inserted into a gene of the genomic nucleic acid molecule that encodes a polypeptide presented on the cell wall of the bacterium. The nucleic acid molecule of the foreign polypeptide can be an antigen that elicits an immunogenic response in the individual, a vaccine, an inhibitor of a pathogen, an immune booster, a modulator, a composition used in the treatment of a disease or condition, or a combination thereof. The bacteria can include, for example, *Streptococcus mitis, Streptococcus oxalis, Streptococcus sanguis, Streptococcus salivarius, Streptococcus constellatus, Lactobacillus casei, Lactobacillus fermenti, Veillonella parvula, Prevotella melaninogenica, Eikenella corrodens, Neisseria mucosa, Actinomyces odontolyticus, Fusobacterium periodonticum, Borrelia vincentii*, and *Actinomyces naeslundii*. The polypeptide expressed by the integrally transformed non-pathogenic, commensal bacterium is described herein.

The present invention relates to methods of delivering a foreign protein to an individual to induce mucosal immunity. The method includes the steps of contacting the integrally transformed non-pathogenic, commensal bacterium, as described herein, with tissue of the oral cavity or upper respiratory tract of the individual in an amount sufficient for colonization of the bacteria. The amount of the integrally transformed bacterium that is contacted with the oral cavity or upper respiratory tract ranges, for example, between about $1\times10^3$ and about $1\times10^{10}$. The method can further include subjecting the individual to an antibiotic prior to contacting the integrally transformed non-pathogenic, commensal bacterium with the individual. The method can also include inserting a nucleic acid molecule that expresses the foreign polypeptide into a gene into the genome of the bacterium that expresses or secretes a cell-wall surface protein. Also, the methods can further include ligating a construct comprising a vector having the nucleic acid molecule that encodes the foreign polypeptide, into the gene in the genome of the bacterium that expresses or secretes a cell-wall surface protein.

The characteristics of the immune response elicited through a mucosal route of vaccination have a number of advantages over parenteral vaccination. First, mucosal immunization results in an abundant production of antigen-specific IgA antibodies at the site of infection. This pathogen-specific response is important not only for the prevention of infection in vaccinated individual, but also helpful in the prevention of a healthy carrier condition and subsequent pathogen transmission to unprotected individuals. Second, in addition to IgA responses, mucosal vaccination elicits systemic IgG responses that correspond to a further defense against pathogens. Such synergistic stimulation of mucosal and systemic antibody production is important for protection against pathogens such as HIV that can infect through both mucosal and systemic route. Third, mucosal immunization at one site results in specific responses at distant sites due to mucosal lymphocyte migration and expression of homing receptors. This is important because defensive immunity against sexually transmitted diseases, for example, can be acquired through oral immunization. Fourth, besides serum IgG and mucosal IgA antibodies, mucosal vaccines have the ability to engage cell mediated responses including T helper and cytotoxic T cell responses, which are important for intracellular pathogen clearance.

Mucosal administration of vaccines is also associated with certain important practical advantages. It is non-invasive, does not require the use of needles, eliminates the need for expensive specialized personnel, and is characterized by reduced adverse effects. The development of efficacious vaccines to serious infectious diseases such as tuberculosis and AIDS has an incalculable commercial potential. The extremely high incidence, morbidity and mortality of these diseases associated with the lack of existing vaccines to them, constitute by definition a solid foundation for investment and commercialization of the final product.

BRIEF DESCRIPTION OF THE DRAWINGS

FIG. 1 is a bar graph showing relative abundance of different strains of commensal bacteria in human oral cavity samples from 225 healthy subjects as determined by DNA-DNA hybridization assay.

FIG. 2 is a schematic illustrating the strategy for integrating genes for HIV or *M. tuberculosis* antigens at the 5'-end of the *S. mitis* pullulanase gene encoding a signal peptide that allows processing and secretion of the *M. tuberculosis* and HIV antigens. The signal peptide consists of several regions including amino terminal end region (N), a hydrophobic core (H) encoding the transmembrane domain of the peptide, a signal peptidase cleavage site (C), and an accessory sequence transport motif (AST).

FIG. 3 is a schematic illustrating the strategy for the transformation of *S. mitis. M. tuberculosis* antigen 85b, HIV antigen HXBc2 or erythromycin resistance gene (ermR) were stably transformed into pulA/SMT0163 gene via homologous recombination. DNA fragments containing either ermR alone (control), HIV/ermR, or 85b/ermR flanked by 250 bp pulA 5' and 3' fragments were ligated into a suicide vector (pCR2.1) for transformation and integration at the pulA locus. The table provides the transformation efficiency of each construct by selection on erythromycin containing plates.

FIG. 4 is a schematic illustrating the results of the genomic polymerase chain reaction (PCR) analysis demonstrating successful integration of HIV HXBc2 gene in the *S. mitis. S. mitis* specific, HIV specific, and ermR specific fragments were amplified using *S. mitis* specific primer set A/B, HIV specific primer C, and ermR-specific primer D. Electrophoresis gel image demonstrates that primers A/B generated the expected 250 bp smt0163 PCR product, while primers C and D generated the expected 1 kb product.

FIG. 5 is a schematic illustrating the results of the genomic PCR analysis demonstrating successful integration of TB 85b gene in the *S. mitis*. Electrophoresis gel image demonstrates that pulA specific primer x and 85b specific primer y generate the expected 250 bp fragment (lanes 2 and 3).

FIGS. 9A and B are graphical representations showing the ability of *rS. mitis* to elicit HIV-specific immune response in mice. Intracellular cytokine staining in CD4+ (FIG. 9A) and CD8+ (FIG. 9B) T cells is illustrated in a series of dot plots. IFNγ, TNFα, and IL-2 positive cells are detected in HIV-1 immunized animals, but not in sham treated control animals.

FIGS. 10A-10G are schematics showing the nucleic acid sequences (in Bold) (SEQ ID NO: 1, 3, 5, 7, 9, 11, 13, 15, 17, 19, 21, 23, 25, and 27) and corresponding *M. tuberculosis* polypeptide sequences (in Bold) (SEQ ID NO: 2, 4, 6, 8, 10, 12, 14, 16, 18, 20, 22, 24, 26, and 28) eluted from MHC class 1 molecules from the macrophages of mice infected with the *M. tuberculosis* bacteria.

FIG. 10H is a table showing *M. tuberculosis* peptide sequences, SEQ ID Nos: 2, 6, 10, 14, 18, 22, and 26, eluted from MHC class 1 molecules from the macrophages of mice infected with the *M. tuberculosis* bacteria. The figure also shows The Institute for Genomic Research (TIGR) annotation, the Swiss-Prot designation, and the protein name.

FIG. 11 is a schematic showing a peptide, SEQ ID NO: 30, in bold, found in the urine of patients with pulmonary tuberculosis, and its corresponding nucleic acid sequence, SEQ ID NO: 29. The figure also shows a DNA sequence (SEQ ID NO: 31) and its corresponding protein sequence (SEQ ID NO: 32) which is a putative molybdopterin biosynthesis protein that is found in *M. tuberculosis* and has 100% homology to SEQ ID NO: 30.

FIG. 12 is a table showing *M. tuberculosis* peptide sequences, SEQ ID Nos: 34, 38, 42, and 46, found in the urine of patients with pulmonary tuberculosis and the *M. tuberculosis* donor protein.

FIGS. 13A-B are schematics showing the nucleic acid sequence (in Bold and Underline) (SEQ ID NO: 33) and corresponding *M. tuberculosis* polypeptide sequence (in Bold and Underline) (SEQ ID NO: 34) found in the urine of patients with pulmonary tuberculosis. Also depicted are homoserine O-acetyltransferase nucleic acid and polypeptide sequences from *M. tuberculosis* having 100% homology to the isolated sequences (SEQ ID NOs: 35 and 36, respectively), along with a table providing TIGR locus name, primary locus name, the Swiss-Prot designation, putative identification, gene symbol, TIGR cellular roles, coordinates, DNA molecule name, gene length, protein length, molecular weight, pl, percent GC, enzyme Commission #, Kingdom, and Family.

FIGS. 14A-C are schematics showing the nucleic acid sequence (in Bold and Underline) (SEQ ID NO: 37) and corresponding *M. tuberculosis* polypeptide sequence (in Bold and Underline) (SEQ ID NO: 38) found in the urine of patients with pulmonary tuberculosis. Also depicted are Chromosome partition protein smc nucleic acid and polypeptide sequences from *M. tuberculosis* having 100% homology to the isolated sequences (SEQ ID NOs: 39 and 40, respectively), along with a table providing the TIGR locus name, primary locus name, the Swiss-Prot designation, putative identification, gene symbol, TIGR cellular roles, coordinates, DNA molecule name, gene length, protein length, molecular weight, pl, percent GC, enzyme Commission #, Kingdom, and Family.

FIGS. 15 A-B are schematics showing the nucleic acid sequence (in Bold and Underline) (SEQ ID NO: 41) and corresponding *M. tuberculosis* polypeptide sequence (in Bold and Underline) (SEQ ID NO: 42) found in the urine of patients with pulmonary tuberculosis. Also depicted are ornithine carbamoyltransferase nucleic acid and polypeptide sequences from *M. tuberculosis* having 100% homology to the isolated sequences (SEQ ID NOs: 43 and 44, respectively), along with a table providing the TIGR locus name, primary locus name, the Swiss-Prot designation, putative identification, gene symbol, TIGR cellular roles, coordinates, DNA molecule name, gene length, protein length, molecular weight, pl, percent GC, enzyme Commission #, Kingdom, and Family.

FIGS. 16A-B are schematics showing the nucleic acid sequence (in Bold and Underline) (SEQ ID NO: 45) and corresponding *M. tuberculosis* polypeptide sequence (in Bold and Underline) (SEQ ID NO: 46) found in the urine of patients with pulmonary tuberculosis. Also depicted are phosphoadenosine phosphosulfate reductase nucleic acid and polypeptide sequences from *M. tuberculosis* having 100% homology to the isolated sequences (SEQ ID NOs: 47 and 48, respectively), along with a table providing the TIGR locus name, primary locus name, the Swiss-Prot designation, putative identification, gene symbol, TIGR cellular roles, coordinates, DNA molecule name, gene length, protein length, molecular weight, pl, percent GC, enzyme Commission #, Kingdom, and Family.

FIGS. 17A and B are sequence listings showing the nucleic acid sequence (SEQ ID NO: 53) and corresponding polypeptide sequence (SEQ ID NO: 54) of the pula signal peptide.

FIGS. 17C and D are sequence listings showing the nucleic acid sequence (SEQ ID NO: 51) and corresponding polypeptide sequence (SEQ ID NO: 52) of the pula-HIVgp120 fusion protein.

FIG. 17E is a sequence listing showing the nucleic acid sequence (SEQ ID NO: 49) and corresponding polypeptide sequence (SEQ ID NO: 50) of the HIV T20 antigen.

DETAILED DESCRIPTION OF THE INVENTION

Figures 6A, 6B, 6C:
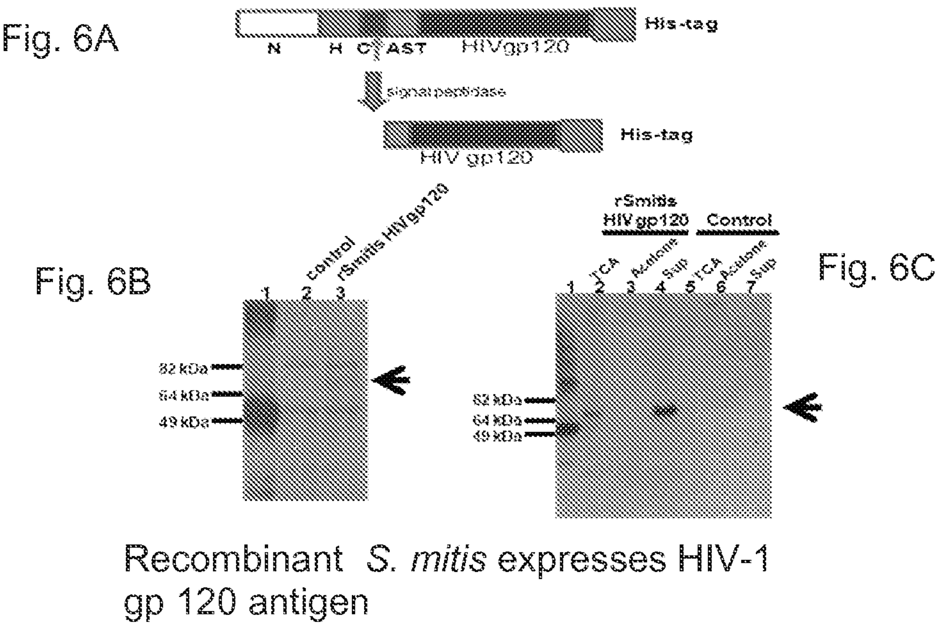
FIG. 6A is a schematic representation of HIV gp120 gene containing C-terminal His-tag incorporated into pulA gene by homologous recombination.
FIG. 6B is a Western blot image demonstrating successful expression of HIV gp120 antigen (approx. 70 kD peptide fragment) detected by anti-His-tag antibody in recombinant *S. mitis* cell lysate (lane 3), but not in parent *S. mitis* cell lysate (lane 2). His-tagged *M. tuberculosis* protein was used as a positive control (lane1).
FIG. 6C is a Western blot image demonstrating successful expression of secreted HIV gp120 antigen (approx. 70 kD peptide) detected by anti-His-tag antibody in bacterial culture supernatant (lane 2 and 4), but not in the supernatant from the parent *S. mitis* (lane 5-7). His-tagged *M. tuberculosis* protein was used as a positive control (lane1).

A description of preferred embodiments of the invention follows.

The present invention relates to compositions and methods for inducing mucosal immunity using an integrally transformed non-pathogenic commensal bacterium in the oral cavity, upper respiratory tract or both. A foreign polypeptide is integrally transformed into a commensal bacterium to be used as a mucosal vaccine.

Mucosal immunity is important for certain diseases such as tuberculosis and acquired immunodeficiency disease syndrome (AIDS). The main protective mechanism of the injectable vaccines is the induction of serum antibodies, mainly IgG, which prevent systemic spread of the pathogen and which can also, through transudation, exert a minor local protective effect at the mucosal surfaces. Mucosal vaccination, however, induces an immune response that more closely resembles natural immunity than the response elicited by injectable vaccine. Mucosally administered vaccine will induce a much stronger mucosal immunity characterized by significantly higher local IgA antibodies and local cell mediated immunity than the injectable vaccine.

Prior to the present invention, formulations and vaccine delivery systems that targeted the development of a strong mucosal immunity were not tested. Nonetheless, the lung and other mucosal structures are an important battleground site for the successful establishment of infections like tuberculosis, AIDS and other infections. Additionally, the compositions of the present invention utilize immunization protocols that generate and maintain a continuous supply of both effector and long-lived memory T cells. This is an important issue because resistance mediated by effector T cells should be highly dependent on the continuous activation of these cells, which are capable of recognizing invading organisms and quickly respond with production of mediators of resistance like IFN-γ.

Commensal Bacteria:

An important innovative aspect of the present invention is the utilization of the commensal oral organism, *S. mitis*, as opposed to attenuated strains of virulent bacteria (and viruses) that were previously tested as live antigen delivery vectors. Examples of these systems are *Salmonella* enteric serovar *typhi* (*S. typhi*) and enteric serovar *typhimurium* (*S. typhimurium*), *Shigella, Vibrio cholerae, Listeria monocytogenes, Mycobacterium bovis* (Bacille Calmette-Guerin, BCG), and *Yersinia enterocolitica*. These vectors impose several restrictions on the downstream steps of vaccine development for human use including poor safety performance and poor long-term colonization. In contrast, *S. mitis* is an excellent commensal colonizer and abundantly present in the mucosal areas of the normal human oral cavity (FIG. 1) and there are no pending safety issues with the organism making it a highly attractive for use as a delivery vector for mucosal immunization.

Commensal bacteria are those that are found in the natural flora of living organisms. Commensal bacteria reside mainly within mucosal sites such as mouth, nose, lungs, gastrointestinal and urogenital tracts. Commensal bacteria are also defined as non-pathogenic, meaning that these organisms do not cause disease or conditions that are harmful to the host. Not only do they not cause harm, but also commensal populations are believed to keep pathogenic species in check by not allowing them to adhere to mucosal surfaces. Besides presenting physical barriers to invading pathogens, mucosal surfaces possess specific local immune systems that provide an important component of protective immunity. Antigen delivery directly to mucosal sites via non-pathogenic commensal bacterial vectors provide a substantial advantage over some of the more conventional vaccines in that live bacteria are capable of stimulating persistent systemic as well as local immune responses. Additionally, commensal bacteria are able to colonize the niche invaded by the pathogen and stimulate an immune response at their portal of entry to prevent infection. Commensal bacteria are used with the compositions and methods of the present invention as a delivery vehicle because they colonize well, and are easily administered, cost efficient, and well-tolerated.

*S. mitis* is a Gram-positive commensal bacterium (class: bacilli) that abundantly colonizes mucosal surfaces of the oral cavity and upper respiratory tract. *S. mitis* is generally not motile, does not form spores and lacks group-specific antigens. *S. mitis*, as well as other strains of commensal bacteria, possesses excellent adjuvant activity for stimulation of cell-mediated immune response, induction of long-term immunological memory and is a very safe candidate for use in recombinant vaccines. Many strains of commensal bacteria that reside on mucosal surfaces are excellent candidates for use as vaccine vehicles into which genetic material of interest can be introduced and successively expressed. The present invention describes such bacterial vehicles for vaccine delivery, whereas integrally transformed non-pathogenic, commensal bacteria is used to express a peptide antigen. Examples of such bacteria include *Streptococcus mitis, Streptococcus oxalis, Streptococcus sanguis, Streptococcus salivarius, Streptococcus constellatus, Lactobacillus casei, Lactobacillus fermenti, Veillonella parvula, Prevotella melaninogenica, Eikenella corrodens, Neisseria mucosa, Actinomyces odontolyticus, Fusobacterium periodonticum, Borrelia vincentii*, and *Actinomyces naeslundii.*

Foreign Polypeptides:

Recombinant commensal bacteria of the present invention are engineered to express foreign polypeptides either on their cell-wall surface or in the secreted form. As used herein, the term "foreign polypeptide" encompasses amino acid chain of any length, including full length proteins (i.e., antigens), wherein their sequence is not encoded by the endogenous bacterial DNA. Foreign polypeptide, in this case, can be any foreign antigen that elicits an immunogenic response including but not limited to a vaccine antigen, an immune booster or modulator of the immune response, pathogen inhibitor, or any combination of the above.

Vaccine antigen used with the compositions of present invention refers to any foreign polypeptide that elicits a protective cell mediated and/or humoral immune response and results in a long-term immunological memory. There are several types of antigen-based vaccines including purified and recombinant vaccines. Purified antigen vaccines, also referred to as subunit vaccines, are composed of molecules purified directly from the pathogenic organisms. Purified antigen vaccines identify molecules that generate a protective immune response including structural proteins, polysaccharides, and chemically inactivated or attenuated bacterial toxins (exotoxins). Examples of purified antigen vaccines include *Streptococcus pneumoniae* and *Neisseria meningitidis* polysaccharides, and *Clostridium tetani* toxin. Most purified antigen vaccines require the use of adjuvant to elicit a strong immune response and multiple immunizations are often required.

Recombinant antigen vaccines are composed of immunogenic proteins produced by genetic engineering. DNA encoding for an immunogenic protein of a pathogen can be inserted into either bacteria, yeast, viruses which infect mammalian cells, or by transfection of mammalian cells. The cells will then produce the protein endogenously and the protein can be harvested.

Recombinant vector vaccines utilize the attenuated versions of certain microbes as recombinant vectors to express target antigens from other pathogens. The major advantage of recombinant vector vaccines is the ability to generate both humoral and cell-mediated immune responses resulting in stronger, longer-lasting protection. The present invention encompasses methods for the development of recombinant vector vaccines based on commensal bacteria stably transformed with constructs encoding the following: *M. leprae* antigens, *M. tuberculosis* antigens, *M. africanum* antigens, *M. intracellulare* antigens, *M. avium* antigens, Treponema antigens, Pertussis antigens, Herpes virus antigens, Measles virus antigens, Mumps virus antigens, Shigella antigens, *Neisseria* antigens, *Borrelia* antigens, Rabies virus antigens, polio virus antigens, human immunodeficiency virus antigens, snake venom antigens, insect venom antigens, hepatitis A, B, C virus, human papilloma virus antigens, *Vibrio cholera*, and fungus organisms such as *Candida albicans, Candida tropicalis, Paracoccidioides brasiliensis* etc. Specific examples include TB and HIV antigenic peptide sequences listed below (SEQ ID NO: 2, 4, 6, 8, 10, 12, 14, 16, 18, 20, 22, 24, 26, 28, 30, 32, 34, 36, 38, 40, 42, 44, 46, 48, or combinations thereof, shown in FIGS. 10-16) and HIV sequences (SEQ ID NO:50, 52 shown in FIG. 17).

An Inhibitor of a Pathogen:

The present invention also describes the development of therapeutic vaccines based on recombinant commensal bacteria expressing a pathogen inhibiting peptide. An inhibitor of pathogen can include any peptide that prevents or reduces the host infection by pathogen by either of the following means inhibition of pathogen interaction with host receptor necessary for infection, inhibition of pathogen replication at the site of entry into the host, inhibition of the assembly of newly formed pathogenic entities (relevant for viral pathogens), and neutralization of toxins released by pathogenic organisms (relevant for bacterial pathogens). One example described in the present invention includes a potent HIV inhibitor peptide, T20, which is a 36 amino acid peptide, expressed by a recombinant *S. mitis*, that acts as a decoy α-helix and prevents HIV-1 infection by disrupting the assembly of the six-helix bundle viral fusion apparatus by mimicking the heptad repeat 2 (HR2) oligomerization domain of the gp41 envelope glycoprotein. Additionally, present invention includes a foreign polypeptide that includes HIV antigen as follows: gp120 env, gp140 env, gp160 env, gag, pol, nef, vif, vpr, vpu, tat, rev, nef or HIV T20. Additional sequences can be designed to express inhibitors of the following pathogens: *Mycobacterium tuberculosis; Mycobacterium leprae; Mycobacterium africanum; Mycobacterium intracellulare; Mycobacterium avium*; Malaria; Diphtheria; Leishmania; *Salmonella*; Treponema; Pertussis; Herpes virus; Measles virus; Mumps virus; Shigella; *Neisseria; Borrelia*; rabies virus; polio virus; Human immunodeficiency virus type I and II; Hepatitis A, B, C virus, *Vibrio cholera*; and fungus organisms such as *Candida albicans, Candida tropicalis, Paracoccidioides brasiliensis* etc. TB vaccines and *Mycobacterium* vaccine antigens are described in U.S. Pat. No. 7,968,694.

An Immune Booster and a Modulator:

The present invention describes the use of additional sequences encoding immune booster and modulator for generation of recombinant commensal bacteria based vaccine. Several classes of immune boosters and modulators can be defined, including: interferons, interleukins, and other cytokines Certain mucosal vaccine antigens do not have the ability to induce a potent adaptive immune response and significant immunoglobulin production and therefore an appropriate adjuvant may be required. Cytokines are powerful modulators of the immune response that have the ability to trigger both adaptive and innate immune response by stimulating Th1 and Th2 responses, maturation of antigen presenting cells, and induction of NK cells and CTLs. Therefore, cytokines can be used as potent mucosal vaccine adjuvants for enhancing the immune response against infectious pathogens. Interferons play an important role in the defense against viral pathogens. They are part of innate immune response and often induced at an early stage during viral infection. Interferons typically stimulate the cells of the innate immune system to increase the expression of MHC molecules and promote more efficient antigen presentation to helper T cells. Therefore, interferons can also be useful adjuvants in the development of recombinant mucosal vaccines. Examples of immune boosters and modulators include: Interleukins, interferons, and cytokines such as IL-1, IL-2, IL-4, IL-6, IL-8, IL-12, IL-17, IL-2 IL-21 and IL-22 and cytokines GMCSF, MCSF, MIP1alpha and beta, TNFalpha and beta, IFNalpha and beta and TGFbeta.

Integrative Transformation:

Bacterial transformation is defined as introduction of foreign genetic material in the form of a DNA plasmid or fragment into bacterial cells resulting in incorporation and expression of exogenous genes by the transformed bacteria. Bacteria that can be transformed are referred to as "competent." Different methods exist for the induction of bacterial competence including calcium chloride based transformation and electroporation. The mechanism of competence induction is based on the ability to create pores in the cell membrane of the bacteria, which allows passive uptake of plasmid DNA into bacterial cells. Plasmids are small circular pieces of DNA of about 2,000 to 10,000 base pairs that may or may not contain important genetic information for the growth of bacteria. The main components of a plasmid include the origin of replication, multiple cloning site, and antibiotic resistance gene. Recombinant plasmid vectors can be created by introducing a gene of interest into a multiple cloning site followed by selection on antibiotic containing growth media. Transformed bacterial cells containing newly introduced plasmid become antibiotic resistant and successfully survive on antibiotic-rich media. A self-replicating recombinant vector, in this case, is propagated in the bacteria independently of the bacterial genome.

In contrast, integrative transformation describes the stable introduction of the whole or part of a recombinant vector into the bacterial genome itself. A construct of interest can be engineered to replace one allele in the genome without affecting any other locus of the bacterial chromosome. The method of choice for a stable introduction of a construct into the bacterial genome is known as "homologous recombination." DNA sequence of the gene to be replaced is known in order to engineer a construct for homologous recombination. The sequence of an engineered construct includes some flanking DNA on both sides that is identical in sequence to the targeted locus.

The present invention encompasses the construction of a vector for stable integration of the genes coding, for example for *M. tuberculosis* Ag85b and HIV1 HXBc2 env-His-tag antigens into the genome of *S. mitis*. These genes were integrated into the signal sequence of pulA gene, coding for the pullulanase enzyme. Pullulanase is an amylolytic exoenzyme that is produced as a cell-surface anchored lipoprotein by Gram-positive bacteria. PulA was selected as an integration site because the gene has a strong promoter and encodes localization motifs for the gene product; furthermore, pulA is not essential for bacterial growth. The recombinant vector was generated by incorporating sequences encoding *M. tuberculosis* and HIV antigens preceded by an accessory sequence transport motif (AST) next to the peptidase cleavage site (C) (FIG. 2). For stable expression, the *M. tuberculosis* and HIV antigen encoding genes along with ermR cassette, flanked on both sides by 250 bp pulA 5' and 3' fragments, were integrated via homologous recombination into the pulA gene of *S. mitis* (FIGS. 3-5). Another vector was constructed in the same manner to incorporate HIV Env gene into *S. mitis* by homologous recombination (FIG. 6).

Methods for Immunizing:

Once a foreign gene has been integrated into the genome of the commensal bacterium, the integrant bacteria, such as those of the present invention, can be introduced to an individual in need thereof. The methods of the present invention include methods for vaccinating an individual by inoculating the individual with the integrant commensal bacteria having the foreign polypeptide. Inoculating procedures can include swabbing, spraying, inhaling or otherwise introducing the integrated commensal bacteria to the oral cavity or upper respiratory system. The integrated commensal bacteria used in the invention can be administered nasally, topically, or by inhalation.

The commensal bacteria should be administered/inoculated in amounts sufficient to result in colonization of the bacteria in the oral cavity, upper respiratory tract, or both. The composition can be administered in a single dose or in more than one dose over a period of time so that the bacteria colonize and the foreign polypeptide confers the desired effect (e.g., is administered to the individual and the individual obtains immunity).

The actual effective amounts of integrant commensal bacteria of the present invention, delivered with or without a carrier, can vary according to the specific composition being utilized, the mode of administration and the age, weight and condition of the patient. For example, as used herein, an effective amount of bacteria is an amount which allows the bacteria to colonize in the oral cavity and/or upper respiratory system. Dosages for a particular individual patient can be determined by one of ordinary skill in the art using conventional considerations (e.g. by means of an appropriate, conventional pharmacological protocol). In an embodiment, the amount of the commensal bacteria of the present invention used to inoculate an individual ranges in an amount between about $10\times10^3$ and about $10\times10^{10}$.

For enteral or mucosal application (including via oral and nasal mucosa), particularly suitable are liquids, drops, or suppositories. A syrup, elixir or the like can be used wherein a sweetened vehicle is employed. Liposomes, microspheres, and microcapsules are available and can be used.

Pulmonary administration can be accomplished, for example, using any of various delivery devices known in the art such as an inhaler. See. e.g., S. P. Newman (1984) in *Aerosols and the Lung*, Clarke and Davis (eds.), Butterworths, London, England, pp. 197-224; PCT Publication No. WO 92/16192; PCT Publication No. WO 91/08760.

The administration of the commensal bacteria (integrants) of the present invention can occur simultaneously or sequentially in time in conjunction with other conventional vaccination systems and protocols or in isolation. A commensal bacterium and/or pharmaceutical composition as described above can be administered simultaneously with or sequentially with an immune enhancer, or other compound known in the art that would be administered with such a vaccine. The compound can be administered before, after or at the same time as the integrated commensal bacteria of the present invention. Thus, the term "co-administration" is used herein to mean that the integrated commensal bacteria and the additional compound (e.g., immune stimulating compound) will be administered at times to achieve an immune response, as described herein. The methods of the present invention are not limited to the sequence in which the compounds are administered, so long as the compound is administered close enough in time to produce the desired effect.

Routes and frequency of administration of the inventive pharmaceutical compositions and vaccines, as well as dosage, will vary from individual to individual or from system to system. In general, the pharmaceutical compositions and vaccines can be administered intranasally or orally. An example of the protocol for inoculating an individual with integrated commensal bacteria is as follows: inoculate three times, one month apart between inoculations.

The compositions of the present invention are preferably formulated as either pharmaceutical compositions or as vaccines for in the induction of protective immunity against the foreign polypeptide in a patient. A patient can be afflicted with a disease, or can be free of detectable disease and/or infection. In other words, protective immunity can be induced to prevent, reduce the severity of, or treat the disease associated with the foreign bacteria.

In one embodiment, pharmaceutical compositions of the present invention comprise one or more of the integrated commensal bacteria, and a physiologically acceptable carrier. Similarly, integrated commensal bacteria comprise one or more the above polypeptides and a non-specific immune response enhancer, such as an adjuvant or a liposome (into which the polypeptide is incorporated).

The integrant commensal bacteria of the present invention can be administered with or without a carrier. The terms "pharmaceutically acceptable carrier" or a "carrier" refer to any generally acceptable excipient or drug delivery composition that is relatively inert and non-toxic. Exemplary carriers include sterile water, salt solutions (such as Ringer's solution), alcohols, gelatin, talc, viscous paraffin, fatty acid esters, hydroxymethylcellulose, polyvinyl pyrolidone, calcium carbonate, carbohydrates (such as lactose, sucrose, dextrose, mannose, albumin, starch, cellulose, silica gel, polyethylene glycol (PEG), dried skim milk, rice flour, magnesium stearate, and the like. Suitable formulations and additional carriers are described in Remington's Pharmaceutical Sciences, (17th Ed., Mack Pub. Co., Easton, Pa.). Such preparations can be sterilized and, if desired, mixed with auxiliary agents, e.g., lubricants, preservatives, stabilizers, wetting agents, emulsifiers, salts for influencing osmotic pressure, buffers, coloring, preservatives and/or aromatic substances and the like which do not deleteriously react with the active compounds. Typical preservatives can include, potassium sorbate, sodium metabisulfite, methyl paraben, propyl paraben, thimerosal, etc. The compositions can also be combined where desired with other active substances, e.g., enzyme inhibitors, to reduce metabolic degradation. A carrier (e.g., a pharmaceutically acceptable carrier) is preferred, but not necessary to administer the compound.

The composition can be a liquid solution, suspension, emulsion, sustained release formulation, gel, mist, or spray. The method of administration can dictate how the composition will be formulated. For example, the composition can be formulated as a suppository, with traditional binders and carriers such as triglycerides.

Measuring the Immunogenicity of the Vaccine:

Once the commensal bacteria are administered to the individual, an individual can be assessed to determine if the vaccine provided an immunogenic response to the foreign polypeptide. The efficacy of a mucosal immunization can be measured by determining the immunogenic response of the person who received the vaccine. The foreign peptides described herein expressed on the surface of recombinant *S. mitis* (*rS. mitis*) have the ability to elicit an immune response. More precisely, administration of *rS. mitis* results in activation of the components of cell mediated immunity, specifically CD4+ and CD8+ T cells, NK cells, B cells and/or macrophages, leading to proliferation and cytokine production including but not limited to IFNγ, TNFα and IL-2 in an immunized individual. Immunological evaluation methods for cell mediated immune response include antigen specific stimulation of cells followed by measurements of secreted cytokines by enzyme-linked immunosorbent assay (ELISA) or multiplex bead assay, measurement of intracellular cytokine levels by flow cytometry, as well as measurements of cell proliferation.

The ability of a polypeptide or bacterial lysate to stimulate the secretion of cytokines can be evaluated by contacting the cells with the polypeptide and measuring cytokine levels in the supernatant. In general, the amount of polypeptide that is sufficient for the evaluation of about $10^5$ cells ranges from about 10 ng/mL to about 100 μg/mL and preferably is about 10 μg/mL. The polypeptide can, but need not, be immobilized on a solid support, such as a bead or a biodegradable microsphere, such as those described in U.S. Pat. Nos. 4,897,268 and 5,075,109. The incubation of polypeptide with the cells is typically performed at 37° C. for about six days. Following incubation with polypeptide, the culture supernatants are assayed for IFN-γ (and/or TNFα and IL-2), which can be evaluated by methods known to those of ordinary skill in the art, such as an enzyme-linked immunosorbent assay (ELISA). In general, a polypeptide that results in the production of at least 50 pg of interferon γ per mL of cultured supernatant (containing $10^4$-$10^5$ T cells per mL) is considered able to stimulate the production of IFN-γ. A polypeptide that stimulates the production of at least 100 pg/mL of TNF α, and/or at least 10 U/mL of IL-2, per $10^5$ T cells (or per $3\times10^5$ PBMC) is considered able to stimulate the production of TNF α and/or IL-2.

Figure 8A:
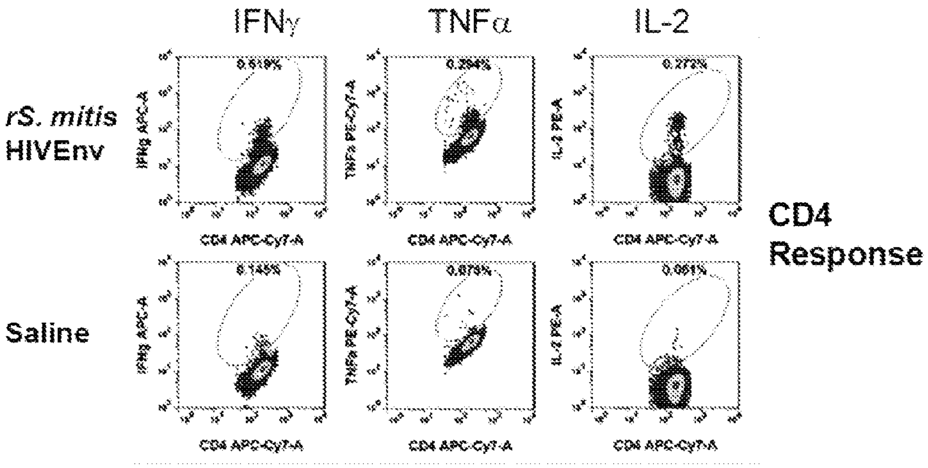
FIGS. 8A and B are graphical representations showing the ability of *rS. mitis* to elicit HIV-specific immune response in mice. Intracellular cytokine staining in CD4+ (FIG. 8A) and CD8+ (FIG. 8B) T cells is illustrated in a series of dot plots. IFNγ, TNFα, and IL-2 positive cells are detected in HIV-1 immunized animals, but not in saline treated control animals.
Figure 8B:
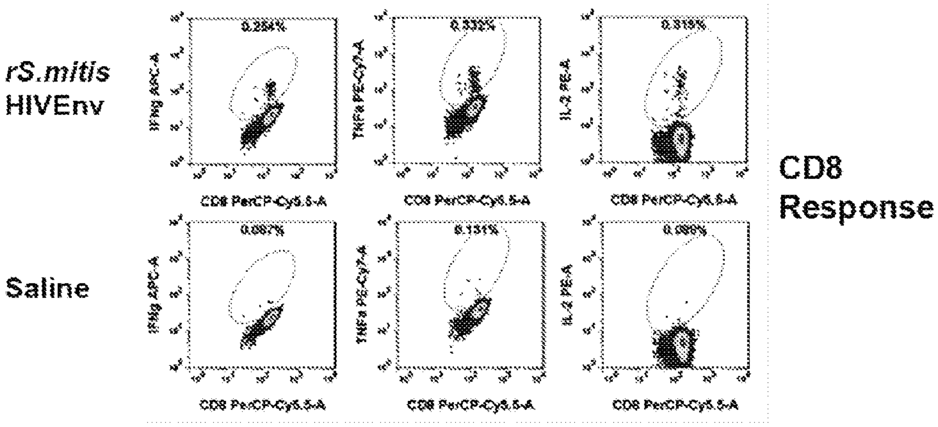

Intracellular cytokine staining is a flow cytometric technique that can detect single cell expression of cytokines and allows simultaneous detection, quantitation, and phenotypic characterization of antigen-specific T cells in PBMC. In this multiparametric flow cytometry based method, antigen specific T cells are identified based on their intracellular accumulation of a cytokine in conjunction with their characteristic CD4+ and CD8+ T cells, activation, effector, memory and mucosal homing surface markers following antigenic stimulation of PBMC. Intracellular cytokine staining assay is performed on PBMC isolated from whole blood of immunized individual by Ficoll gradient centrifugation. Cells are then restimulated by contact with polypeptide (e.g., an immunogenic antigen, or a portion or other variant thereof) or recombinant bacterial lysate for 6-10 hours at 37 C. Restimulated cells are then permeabilized and contacted with fluorescently labeled monoclonal antibodies against interferon γ, TNFα, IL-2, and granzyme) as well as antibodies against surface markers characteristic for particular cell type. Percent of IFN-γ, TNFα, and IL-2 positive cells is then determined using appropriate software (FIGS. 8, 9). A polypeptide that stimulates statistically significant increase in the number of IFN-γ, TNFα, and IL-2 positive cells when compared to control is considered able to stimulate cytokine production.

Polypeptides and their Function:

The present invention relates to polypeptide molecules encoded by the recombinant commensal bacteria including antigenic portions of TB, HIV, Plasmodium, Leishmania, herpes virus, or hepatitis virus. The present invention includes polypeptide molecules that are encoded by the nucleic acid of the recombinant commensal bacteria and which contain the sequence of any one of the antigenic TB amino acid sequences (e.g., SEQ ID NO: 2, 4, 6, 8, 10, 12, 14, 16, 18, 20, 22, 24, 26, 28, 30, 32, 34, 36, 38, 40, 42, 44, 46, 48, or combinations thereof, shown FIGS. 10-16) or HIV sequences (e.g., SEQ ID NO: 50, 52 shown in FIG. 17), or any of the above fused to the pulA signal peptide. The present invention also pertains to polypeptide molecules that are encoded by nucleic acid sequence of the transformed commensal bacteria and that include the nucleic acid sequences of SEQ ID NO: 1, 3, 5, 7, 9, 11, 13, 15, 17, 19, 21, 23, 25, 27, 29, 31, 33, 35, 37, 39, 41, 43, 45, 47, or combinations thereof.

As used herein, the term "polypeptide" encompasses amino acid chains of any length, including full length proteins (i.e., antigens), wherein the amino acid residues are linked by covalent peptide bonds. Thus, a polypeptide comprising an immunogenic portion of any of the above named antigens can consist entirely of the immunogenic portion, or can contain additional sequences. The additional sequences can be derived from the native antigens or can be heterologous, and such sequences can (but need not) be immunogenic.

The compositions and methods of the present invention also encompass variants of the above polypeptides and DNA molecules. A polypeptide "variant," as used herein, is a polypeptide that differs from the recited polypeptide only in conservative substitutions and/or modifications, such that the therapeutic, antigenic and/or immunogenic properties of the polypeptide are retained. A variant of a specific antigen will therefore stimulate cell proliferation and/or interferon production in Th1 cells raised against that specific antigen. Polypeptide variants preferably exhibit at least about 70%, more preferably at least about 90% and most preferably at least about 95% homology to the identified polypeptides. For polypeptides with immunoreactive properties, variants can, alternatively, be identified by modifying the amino acid sequence of one of the above polypeptides, and evaluating the immunoreactivity of the modified polypeptide. Such modified sequences can be prepared and tested using, for example, the representative procedures described herein.

As used herein, a "conservative substitution" is one in which an amino acid is substituted for another amino acid that has similar properties, such that one skilled in the art of peptide chemistry would expect the secondary structure and hydropathic nature of the polypeptide to be substantially unchanged.

Variants can also, or alternatively, contain other modifications, including the deletion or addition of amino acids that have minimal influence on the antigenic properties, secondary structure and hydropathic nature of the polypeptide. For example, a polypeptide can be conjugated to a signal (or leader) sequence at the N-terminal end of the protein which co-translationally or post-translationally directs transfer of the protein. The polypeptide can also be conjugated to a linker or other sequence for ease of synthesis, purification or identification of the polypeptide (e.g., poly-His), or to enhance binding of the polypeptide to a solid support. For example, a polypeptide can be conjugated to an immunoglobulin Fc region.

The present invention also encompasses proteins and polypeptides, variants thereof, or those having amino acid sequences analogous to the amino acid sequences of antigenic polypeptides described herein. Such polypeptides are defined herein as antigenic analogs (e.g., homologues), or mutants or derivatives. "Analogous" or "homologous" amino acid sequences refer to amino acid sequences with sufficient identity of any one of the amino acid sequences so as to possess the biological activity (e.g., the ability to elicit a protective immune response to antigen expressed by commensal bacteria) of any one of the native polypeptides. For example, an analog polypeptide can be produced with "silent" changes in the amino acid sequence wherein one, or more, amino acid residues differ from the amino acid residues of any one of the protein, yet still possesses the function or biological activity of the antigen peptide. Examples of such differences include additions, deletions or substitutions of residues of the amino acid sequence of antigen peptides. Also encompassed by the present invention are analogous polypeptides that exhibit greater, or lesser, biological activity of any one of the proteins of the present invention. Such polypeptides can be expressed by mutating (e.g., substituting, deleting or adding) nucleic acid residues of any of the sequences described herein. Such mutations can be performed using methods described herein and those known in the art. In particular, the present invention relates to homologous polypeptide molecules having at least about 70% (e.g., 75%, 80%, 85%, 90% or 95%) identity or similarity with SEQ ID NO: 2, 4, 6, 8, 10, 12, 14, 16, 18, 20, 22, 24, 26, 28, 30, 32, 34, 36, 38, 40, 42, 44, 46, 48, or combination thereof. Percent "identity" refers to the amount of identical nucleotides or amino acids between two nucleotides or amino acid sequences, respectfully. As used herein, "percent similarity" refers to the amount of similar or conservative amino acids between two amino acid sequences.

Homologous polypeptides can be determined using methods known to those of skill in the art. Initial homology searches can be performed at NCBI against the GenBank, EMBL and SwissProt databases using, for example, the BLAST network service. Altschuler, S. F., et al., J. Mol. Biol., 215:403 (1990), Altschuler, S. F., Nucleic Acids Res., 25:3389-3402 (1998). Computer analysis of nucleotide sequences can be performed using the MOTIFS and the FindPatterns subroutines of the Genetics Computing Group (GCG, version 8.0) software. Protein and/or nucleotide comparisons were performed according to Higgins and Sharp (Higgins, D. G. and Sharp, P. M., Gene, 73:237-244 (1988) e.g., using default parameters).

Additionally, the individual isolated polypeptides of the present invention are biologically active or functional and play various roles in bacteria as well. For example, an isolated polypeptide, such as SEQ ID NO: 6 is a glutamine-transport transmembrane protein ABC transporter. Likewise, SEQ ID NO: 22 is a cationic amino acid transport integral member protein, and SEQ ID NO: 26 is a cationic transporting P-type ATPase. SEQ ID NO: 32, is a molybdopterin biosynthesis protein. The present invention includes fragments of these isolated amino acid sequences that still possess the function or biological activity of the sequence. For example, polypeptide fragments comprising deletion mutants of the antigenic TB proteins can be designed and expressed by well-known laboratory methods. Fragments, homologues, or analogous polypeptides can be evaluated for biological activity, as described herein.

The present invention also encompasses biologically active derivatives or analogs of the above described antigenic polypeptides, referred to herein as peptide mimetics. Mimetics can be designed and produced by techniques known to those of skill in the art. (see e.g., U.S. Pat. Nos. 4,612,132; 5,643,873 and 5,654,276). These mimetics can be based, for example, on a specific amino acid sequence and maintain the relative position in space of the corresponding amino acid sequence. These peptide mimetics possess biological activity similar to the biological activity of the corresponding peptide compound, but possess a "biological advantage" over the corresponding antigenic TB amino acid sequence with respect to one, or more, of the following properties: solubility, stability and susceptibility to hydrolysis and proteolysis.

Methods for preparing peptide mimetics include modifying the N-terminal amino group, the C-terminal carboxyl group, and/or changing one or more of the amino linkages in the peptide to a non-amino linkage. Two or more such modifications can be coupled in one peptide mimetic molecule. Modifications of peptides to produce peptide mimetics are described in U.S. Pat. Nos. 5,643,873 and 5,654,276. Other forms of the antigenic polypeptides, encompassed by the present invention, include those which are "functionally equivalent." This term, as used herein, refers to any nucleic acid sequence and its encoded amino acid, which mimics the biological activity of the polypeptides and/or functional domains thereof.

Nucleic Acid Sequences, Plasmids, Vectors and Host Cells:

The present invention, in one embodiment, includes an isolated nucleic acid molecule integrated into the commensal bacteria, having a sequence of SEQ ID NO: 1, 3, 5, 7, 9, 11, 13, 15, 17, 19, 21, 23, 25, 27, 29, 31, 33, 35, 37, 39, 41, 43, 45, 47, or combinations thereof. See FIGS. 10-17. The present invention includes sequences as recited in FIGS. 10-17, as well as the coding regions thereof.

As used herein, the terms "DNA molecule" or "nucleic acid molecule" include both sense and anti-sense strands, cDNA, genomic DNA, recombinant DNA, RNA, and wholly or partially synthesized nucleic acid molecules. A nucleotide "variant" is a sequence that differs from the recited nucleotide sequence in having one or more nucleotide deletions, substitutions or additions. Such modifications can be readily introduced using standard mutagenesis techniques Nucleotide variants can be naturally occurring allelic variants, or non-naturally occurring variants. Variant nucleotide sequences preferably exhibit at least about 70%, more preferably at least about 80% and most preferably at least about 90% homology to the recited sequence. Such variant nucleotide sequences will generally hybridize to the recited nucleotide sequence under stringent conditions. In one embodiment, "stringent conditions" refers to prewashing in a solution of 6×SSC, 0.2% SDS; hybridizing at 65° Celsius, 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

The present invention also encompasses genomic commensal DNA having isolated nucleic acid sequences that encode TB and HIV polypeptides, and in particular, those which encode a polypeptide molecule having an amino acid sequence of SEQ ID NO: 2, 4, 6, 8, 10, 12, 14, 16, 18, 20, 22, 24, 26, 28, 30, 32, 34, 36, 38, 40, 42, 44, 46, 48, or combinations thereof. These nucleic acid sequences encode polypeptides that stimulate a protective immunogenic response and/or are involved the functions further described herein.

As used herein, an "isolated" gene or nucleotide sequence which is not flanked by nucleotide sequences which normally (e.g., in nature) flank the gene or nucleotide sequence (e.g., as in genomic sequences) and/or has been completely or partially purified from other transcribed sequences (e.g., as in a cDNA or RNA library). Thus, an isolated gene or nucleotide sequence can include a gene or nucleotide sequence which is synthesized chemically or by recombinant means. Nucleic acid constructs contained in a vector are included in the definition of "isolated" as used herein. Also, isolated nucleotide sequences include recombinant nucleic acid molecules and heterologous host cells, as well as partially or substantially or purified nucleic acid molecules in solution. In vivo and in vitro RNA transcripts of the present invention are also encompassed by "isolated" nucleotide sequences. Such isolated nucleotide sequences are useful for the manufacture of the encoded antigenic TB polypeptide, for detecting the presence (e.g., by PCR amplification and DNA sequencing) or expression (e.g., by reverse transcription (RT)-PCR and DNA sequencing) of related genes in cells or tissue, and for gene mapping (e.g., by in situ hybridization).

The antigenic nucleic acid sequences of the present invention include homologous nucleic acid sequences. "Analogous" or "homologous" nucleic acid sequences refer to nucleic acid sequences with sufficient identity of any one of the TB nucleic acid sequences, such that once encoded into polypeptides, they possess the biological activity of any one of the antigenic polypeptides described herein. For example, an analogous nucleic acid molecule can be produced with "silent" changes in the sequence wherein one, or more, nucleotides differs from the nucleotides of any one of the polypeptides described herein, yet, once encoded into a polypeptide, still possesses its function or biological activity. Examples of such differences include additions, deletions or substitutions. Also encompassed by the present invention are nucleic acid sequences that encode analogous polypeptides that exhibit greater, or lesser, biological activity of the TB proteins of the present invention. In particular, the present invention is directed to nucleic acid molecules having at least about 70% (e.g., 75%, 80%, 85%, 90% or 95%) identity with SEQ ID NO: 1, 3, 5, 7, 9, 11, 13, 15, 17, 19, 21, 23, 25, 27, 29, 31, 33, 35, 37, 39, 41, 43, 45, 47, or combinations thereof.

The nucleic acid molecules of the present invention, including the full length sequences, the partial sequences, functional fragments and homologues, once encoded into polypeptides, elicit a specific immunogenic TB response, or has the function of the polypeptide, as further described herein. The homologous nucleic acid sequences can be determined using methods known to those of skill in the art, and by methods described herein including those described for determining homologous polypeptide sequences.

Also encompassed by the present invention are nucleic acid sequences, DNA or RNA, which are substantially complementary to the DNA sequences encoding the antigenic polypeptides of the present invention. Such sequences can be used to design PCR primers to amplify and isolate homologous DNA coding sequences from related *Mycobacteria* spp. The present invention includes sequences those that specifically hybridize under conditions of stringency known to those of skill in the art. As defined herein, substantially complementary means that the nucleic acid need not reflect the exact sequence of the TB sequences, but must be sufficiently similar in sequence to permit hybridization with TB nucleic acid sequence under high stringency conditions. For example, non-complementary bases can be interspersed in a nucleotide sequence, or the sequences can be longer or shorter than the TB nucleic acid sequence, provided that the sequence has a sufficient number of bases complementary to the TB sequence to allow hybridization therewith. Conditions for stringency are described in e.g., Ausubel, F. M., et al., Current Protocols in Molecular Biology, (Current Protocol, 1994), and Brown, et al., Nature, 366:575 (1993); and further defined in conjunction with certain assays.

In another embodiment, the present invention includes genomic DNA that has nucleic acid molecules (e.g., probes or primers) that hybridize to the antigenic sequences, SEQ ID NO:1, 3, 5, 7, 9, 11, 13, 15, 17, 19, 21, 23, 25, 27, 29, 31, 33, 35, 37, 39, 41, 43, 45, 47, or combinations thereof under high or moderate stringency conditions. In one aspect, the present invention includes molecules that hybridize or contain at least about 20 contiguous nucleotides or longer in length (e.g., 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, or 4000). Such molecules hybridize to one of the TB nucleic acid sequences under high stringency conditions. The present invention includes such molecules and those that encode a polypeptide that has the functions or biological activity described herein.

Typically the nucleic acid probe comprises a nucleic acid sequence (e.g. SEQ ID NO: 1, 3, 5, 7, 9, 11, 13, 15, 17, 19, 21, 23, 25, 27, 29, 31, 33, 35, 37, 39, 41, 43, 45, 47, or combinations thereof) and is of sufficient length and complementarity to specifically hybridize to a nucleic acid sequence that encodes an antigenic polypeptide. For example, a nucleic acid probe can be at least about 5%, 10%, 20%, 30%, 40%, 50%, 60%, 70%, 80% or 90% the length of the TB nucleic acid sequence. The requirements of sufficient length and complementarity can be easily determined by one of skill in the art. Suitable hybridization conditions (e.g., high stringency conditions) are also described herein. Additionally, the present invention encompasses fragments of the polypeptides of the present invention or nucleic acid sequences that encodes a polypeptide wherein the polypeptide has the biologically activity of the polypeptides recited herein.

Such fragments are useful as probes for assays described herein, and as experimental tools, or in the case of nucleic acid fragments, as primers. A preferred embodiment includes primers and probes which selectively hybridize to the nucleic acid constructs encoding any one of the recited polypeptides. For example, nucleic acid fragments which encode any one of the domains described herein are also implicated by the present invention.

Stringency conditions for hybridization refers to conditions of temperature and buffer composition which permit hybridization of a first nucleic acid sequence to a second nucleic acid sequence, wherein the conditions determine the degree of identity between those sequences which hybridize to each other. Therefore, "high stringency conditions" are those conditions wherein only nucleic acid sequences which are very similar to each other will hybridize. The sequences can be less similar to each other if they hybridize under moderate stringency conditions. Still less similarity is needed for two sequences to hybridize under low stringency conditions. By varying the hybridization conditions from a stringency level at which no hybridization occurs, to a level at which hybridization is first observed, conditions can be determined at which a given sequence will hybridize to those sequences that are most similar to it. The precise conditions determining the stringency of a particular hybridization include not only the ionic strength, temperature, and the concentration of destabilizing agents such as formamide, but also factors such as the length of the nucleic acid sequences, their base composition, the percent of mismatched base pairs between the two sequences, and the frequency of occurrence of subsets of the sequences (e.g., small stretches of repeats) within other non-identical sequences. Washing is the step in which conditions are set so as to determine a minimum level of similarity between the sequences hybridizing with each other. Generally, from the lowest temperature at which only homologous hybridization occurs, a 1% mismatch between two sequences results in a 1° C. decrease in the melting temperature ($T_m$) for any chosen SSC concentration. Generally, a doubling of the concentration of SSC results in an increase in the $T_m$ of about 17° C. Using these guidelines, the washing temperature can be determined empirically, depending on the level of mismatch sought. Hybridization and wash conditions are explained in Current Protocols in Molecular Biology (Ausubel, F. M. et al., eds., John Wiley & Sons, Inc., 1995, with supplemental updates) on pages 2.10.1 to 2.10.16, and 6.3.1 to 6.3.6.

High stringency conditions can employ hybridization at either (1) 1×SSC (10×SSC=3 M NaCl, 0.3 M $Na_3$-citrate . . . $2H_2O$ (88 g/liter), pH to 7.0 with 1 M HCl), 1% SDS (sodium dodecyl sulfate), 0.1-2 mg/ml denatured calf thymus DNA at 65° C., (2) 1×SSC, 50% formamide, 1% SDS, 0.1-2 mg/ml denatured calf thymus DNA at 42° C., (3) 1% bovine serum albumin (fraction V), 1 mM $Na_2$ . . . EDTA, 0.5 M $NaHPO_4$ (pH 7.2) (1 M $NaHPO_4$=134 g $Na_2HPO_4$ . . . $7H_2O$, 4 ml 85% $H_3PO_4$ per liter), 7% SDS, 0.1-2 mg/ml denatured calf thymus DNA at 65° C., (4) 50% formamide, 5×SSC, 0.02 M Tris-HCl (pH 7.6), 1×Denhardt's solution (100×=10 g Ficoll 400, 10 g polyvinylpyrrolidone, 10 g bovine serum albumin (fraction V), water to 500 ml), 10% dextran sulfate, 1% SDS, 0.1-2 mg/ml denatured calf thymus DNA at 42° C., (5) 5×SSC, 5×Denhardt's solution, 1% SDS, 100 μg/ml denatured calf thymus DNA at 65° C., or (6) 5×SSC, 5×Denhardt's solution, 50% formamide, 1% SDS, 100 μg/ml denatured calf thymus DNA at 42° C., with high stringency washes of either (1) 0.3-0.1× SSC, 0.1% SDS at 65° C., or (2) 1 mM $Na_2EDTA$, 40 mM $NaHPO_4$ (pH 7.2), 1% SDS at 65° C. The above conditions are intended to be used for DNA-DNA hybrids of 50 base pairs or longer. Where the hybrid is believed to be less than 18 base pairs in length, the hybridization and wash temperatures should be 5-10° C. below that of the calculated $T_m$ of the hybrid, where $T_m$ in ° C.=(2× the number of A and T bases)+(4× the number of G and C bases). For hybrids believed to be about 18 to about 49 base pairs in length, the $T_m$ in ° C.=(81.5° C.+16.6($\log_{10}$M)+0.41(% G+C)−0.61 (% formamide)−500/L), where "M" is the molarity of monovalent cations (e.g., $Na^+$), and "L" is the length of the hybrid in base pairs.

Moderate stringency conditions can employ hybridization at either (1) 4×SSC, (10×SSC=3 M NaCl, 0.3 M $Na_3$-citrate . . . $2H_2O$ (88 g/liter), pH to 7.0 with 1 M HCl), 1% SDS (sodium dodecyl sulfate), 0.1-2 mg/ml denatured calf thymus DNA at 65° C., (2) 4×SSC, 50% formamide, 1% SDS, 0.1-2 mg/ml denatured calf thymus DNA at 42° C., (3) 1% bovine serum albumin (fraction V), 1 mM $Na_2$ . . . EDTA, 0.5 M $NaHPO_4$ (pH 7.2) (1 M $NaHPO_4$=134 g $Na_2HPO_4$ . . . $7H_2O$, 4 ml 85% $H_3PO_4$ per liter), 7% SDS, 0.1-2 mg/ml denatured calf thymus DNA at 65° C., (4) 50% formamide, 5×SSC, 0.02 M Tris-HCl (pH 7.6), 1×Denhardt's solution (100×=10 g Ficoll 400, 10 g polyvinylpyrrolidone, 10 g bovine serum albumin (fraction V), water to 500 ml), 10% dextran sulfate, 1% SDS, 0.1-2 mg/ml denatured calf thymus DNA at 42° C., (5) 5×SSC, 5×Denhardt's solution, 1% SDS, 100 μg/ml denatured calf thymus DNA at 65° C., or (6) 5×SSC, 5×Denhardt's solution, 50% formamide, 1% SDS, 100 μg/ml denatured calf thymus DNA at 42° C., with moderate stringency washes of 1×SSC, 0.1% SDS at 65° C. The above conditions are intended to be used for DNA-DNA hybrids of 50 base pairs or longer. Where the hybrid is believed to be less than 18 base pairs in length, the hybridization and wash temperatures should be 5-10° C. below that of the calculated $T_m$ of the hybrid, where $T_m$ in ° C.=(2× the number of A and T bases)+(4× the number of G and C bases). For hybrids believed to be about 18 to about 49 base pairs in length, the $T_m$ in ° C.=(81.5° C.+16.6 ($\log_{10}$M)+0.41(% G+C)−0.61 (% formamide)−500/L), where "M" is the molarity of monovalent cations (e.g., Na+), and "L" is the length of the hybrid in base pairs.

Low stringency conditions can employ hybridization at either (1) 4×SSC, (10×SSC=3 M NaCl, 0.3 M $Na_3$-citrate . . . $2H_2O$ (88 g/liter), pH to 7.0 with 1 M HCl), 1% SDS (sodium dodecyl sulfate), 0.1-2 mg/ml denatured calf thymus DNA at 50° C., (2) 6×SSC, 50% formamide, 1% SDS, 0.1-2 mg/ml denatured calf thymus DNA at 40° C., (3) 1% bovine serum albumin (fraction V), 1 mM $Na_2$ . . . EDTA, 0.5 M $NaHPO_4$ (pH 7.2) (1 M $NaHPO_4$=134 g $Na_2HPO_4$ . . . $7H_2O$, 4 ml 85% $H_3PO_4$ per liter), 7% SDS, 0.1-2 mg/ml denatured calf thymus DNA at 50° C., (4) 50% formamide, 5×SSC, 0.02 M Tris-HCl (pH 7.6), 1×Denhardt's solution (100×=10 g Ficoll 400, 10 g polyvinylpyrrolidone, 10 g bovine serum albumin (fraction V), water to 500 ml), 10% dextran sulfate, 1% SDS, 0.1-2 mg/ml denatured calf thymus DNA at 40° C., (5) 5×SSC, 5×Denhardt's solution, 1% SDS, 100 μg/ml denatured calf thymus DNA at 50° C., or (6) 5×SSC, 5×Denhardt's solution, 50% formamide, 1% SDS, 100 μg/ml denatured calf thymus DNA at 40° C., with low stringency washes of either 2×SSC, 0.1% SDS at 50° C., or (2) 0.5% bovine serum albumin (fraction V), 1 mM $Na_2$EDTA, 40 mM $NaHPO_4$ (pH 7.2), 5% SDS. The above conditions are intended to be used for DNA-DNA hybrids of 50 base pairs or longer. Where the hybrid is believed to be less than 18 base pairs in length, the hybridization and wash temperatures should be 5-10° C. below that of the calculated $T_m$ of the hybrid, where $T_m$ in ° C.=(2× the number of A and T bases)+(4× the number of G and C bases). For hybrids believed to be about 18 to about 49 base pairs in length, the $T_m$ in ° C.=(81.5° C.+16.6($\log_{10}$M)+0.41(% G+C)−0.61 (% formamide)−500/L), where "M" is the molarity of monovalent cations (e.g., Na.+), and "L" is the length of the hybrid in base pairs.

Immunogenic antigens can be produced recombinantly using a DNA sequence that encodes the antigen, which has been inserted into an expression vector and expressed in an appropriate host cell. DNA sequences encoding antigens can, for example, be identified by screening an appropriate genomic or cDNA expression library with sera obtained from patients infected with *M. tuberculosis*, HIV, Plasmodium, Leishmania, herpes virus, or hepatitis virus. Such screens can generally be performed using techniques well known to those of ordinary skill in the art. For example, using oligonucleotide primers designed from above DNA sequences, PCR can be employed to isolate a gene from a cDNA or genomic library.

Alternatively, genomic or cDNA libraries derived from *M. tuberculosis*, HIV, Plasmodium, Leishmania, herpes virus, or hepatitis virus can be screened directly using peripheral blood mononuclear cells (PBMCs) or T cell lines or clones derived from one or more immune individuals. In general, PBMCs and/or T cells for use in such screens can be prepared as described below. Direct library screens can generally be performed by assaying pools of expressed recombinant proteins for the ability to induce proliferation and/or interferon production in T cells derived from an immune individual.

The invention also provides vectors, plasmids or viruses containing one or more of the nucleic acid molecules (e.g., having the sequence of SEQ ID NO:1, 3, 5, 7, 9, 11, 13, 15, 17, 19, 21, 23, 25, 27, 29, 31, 33, 35, 37, 39, 41, 43, 45, 47, or combinations thereof). Suitable vectors for use in eukaryotic and prokaryotic cells are known in the art and are commercially available or readily prepared by a skilled artisan.

EXEMPLIFICATION

Example 1

To generate recombinant *S. mitis* (*rS. mitis*), it was first established that strain NCTC 12261 could be transformed and could express foreign genes. The strategy was to express foreign vaccine antigens in the secreted form, which is necessary for bacterial-expressed antigens to be immunogenic. Thus far the genes encoding *M. tuberculosis* Ag85b and HIV-1 HXBc2 env-His-tag in-frame have been successfully integrated in the genome of *S. mitis*. These genes were synthetically produced and had with codons optimized for *S. mitis*. The genes integrated at the 5' end of the pullulanase gene (pulA/Smt0163) encoding a signal peptide that allows processing and secretion of the *M. tuberculosis* and HIV antigens. FIG. 2 illustrates this integration strategy. The signal peptide has an amino-terminal region (N), a hydrophobic core (H), a signal peptidase cleavage site (C), and an accessory Sec transport motif (AST). For stable expression, the *M. tuberculosis* Antigen 85b and HIV HXBc2 genes or the ermR cassette were integrated via homologous recombination into the pulA gene of *S. mitis*. PulA was selected as the integration site because the gene has a strong promoter and encodes localization motifs for the gene product; furthermore pulA was not essential for bacterial growth. A DNA fragment containing ermR alone (control) or HIV and ermR or 85b and ermR flanked by 250 bp pulA 5' and 3' fragments was constructed and ligated into a suicide vector (pCR2.1) for transformation and integration at the pulA locus (FIG. 3A). *S. mitis* transformants were selected on erythromycin-containing plates. To test whether a foreign gene was integrated into *S. mitis* a genomic PCR analysis was performed. PCR analysis showed that the *S. mitis*-specific primers A/B generated the expected 250 bp smt0163 PCR product, while the HIV-specific primer C and ermR-specific primer D generated the expected 1 kb product (FIG. 4). In addition, *S. mitis* pulA specific primer X and 85b-specific primer y generated the expected 250 bp product (FIG. 5, lanes 2-3).

Next, the expression of Env antigen in *S. mitis* using the C-terminal His-tag fused to HIV antigen for detection was determined. An expression cassette containing the HIV gene was then transformed into *S. mitis* for homologous recombination into the pulA gene. *S. mitis* vaccine vector candidates were grown to mid-log phase in Todd-Hewitt Broth medium with erythromycin. Proteins from cell lysates (1 μg) and from concentrated supernatants (10 ml) were size fractionated by SDS-PAGE. HIV HXBc2 gp120 (Env) in the bacterial pellets and as a secreted product in the supernatants was detected by Western blotting using horseradish peroxidase conjugated anti-His tag antibody (Penta-His, Qiagen) and a chemiluminescence substrate (Invitrogen). HIV Env linked to the PulA signal peptide was expressed in *S. mitis* cell lysates of a representative recombinant clone (FIGS. 6A and 6B). Lysates also contained proteins that crossreact with the anti-His-tag antibody (FIG. 6A). In addition, secreted Env was detected in bacterial culture supernatants (FIG. 5C). 100 ng of His-tagged *M. tuberculosis* protein (MT0401) was used as a positive control (FIGS. 6B and 6C, lane 1).

The arrow denotes the Env protein band present in the TCA-pecipitated (FIG. 5C, lane 2) and Amicon-concentrated supernatant (FIG. 6C, lane 4), although not in acetone precipitates (FIG. 6C, lane 3). As expected, the HIV Env was not expressed in culture supernatants of parent *S. mitis* cells (FIG. 6C, lanes 5-7). The apparent molecular weight was similar to the expected molecular weight (of approximately 70 kDa), suggesting that Env was not glycosylated in *S. mitis*.

Figures 7A, 7B:
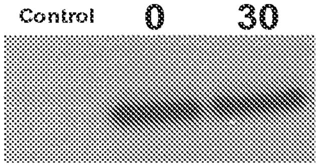
FIG. 7A is a table illustrating the stability of the recombinant *S. mitis* vector over 30 generations of replication without antibiotic. Four clones HIVgp120A-D were grown without antibiotic for 30 generations of replication. The table expresses the stability of the recombinant vector as a number of ermR colonies over the total number of colonies streaked
FIG. 7B is a Western blot showing that the expression of HIV gp120 antigen remains unchanged over the 30 generations of replication.

Recombinant *S. mitis* vector is stable after serial passages in vitro. To determine the stability of the integrated Env gene in *rS. mitis*, four clones were picked at random and grown anaerobically for 24 hours which represents approximately three generations (7.1 hours per generation) in Todd-Hewitt Broth (THB) without erythromycin. Cultures were diluted and grown for another 24 hours for a total of approximately 6 generations. Cultures were diluted again and grown on THB plates without erythromycin. From these plates, between 100 and 150 colonies were picked at random and streaked to THB plates with and without erythromycin. This procedure was repeated to measure the stability of the *rS. mitis* clones over approximately 30 generations on plates with and without antibiotic. Loss of erythromycin-resistance was taken as an indication of the loss of the Env transgene. The progeny from all four clones were stable, with no loss of erythromycin resistance after ten subcultures or 30 generations of replication without antibiotic (FIG. 7A). In addition, the expression of Env in the same daughter clones was analyzed. Western blot analysis revealed that they secreted the same amount of Env antigen as the original *rS. mitis* clones; Env production in a representative daughter clone after 30 generations and the original HIVgp120A clone is shown (FIG. 7B). These results indicate that the resulting *rS. mitis* is stable, a property that makes it a strong candidate for further preclinical testing in animal models.

In summary, it was shown that *S. mitis* can undergo integrative transformation and that the progenies express HIV-1 Env antigen and are highly stable. These results demonstrate that a stable gene expression system in *S. mitis* for constructing an *rS. mitis* vaccine vector we have successfully developed.

*rS. mitis* elicits HIV-specific immune responses in mice. 6-week old Balb/c mice (4 mice per group) were inoculated i.p. twice (four weeks apart) with 108 cfu live *rS. mitis* expressing the HIV-1 HXBc2 Env protein (*rS. mitis* HIVEnv), *S. mitis* with an intergrated ermr gene only (*rS. mitis* sham) or saline (Saline). One week following the second inoculation, mice were bled retrorbitally to isolate peripheral blood mononuclear cells (PBMC) which were then stimulated with either 5 μg/ml *S. mitis* soluble lysate or 5 μg/ml recombinant HXBc2 protein in vitro. Intracellular cytokine staining (ICS) was performed as previously described to assess T cell responses (7). Using the Flowjo software 7.6.3 (Tree Star), IFNγ+, TNFα+, IL-2+, CD4+ or CD8+ T cells were determined, and results from a representative mouse from each group is shown (FIGS. 8 and 9). The Student's t test was used to determine cytokine response difference between the groups and a P value<0.5 was considered significant. ICS analysis revealed that that PBMC from mice vaccinated with the *rS. mitis* HIVEnv had statistically significant higher CD4 T cell responses specific to *S. mitis* lysate antigens compared to saline injected animals (Saline), producing more IFNγ (P<0.003), TNFα (P<0.02) and IL-2 (P<0.002) (FIG. 6). The *rS. mitis* HIVEnv-vaccine group also generated higher frequency *S. mitis* specific-CD8 T cells producing IFNγ (P<0.02), and TNFα (P<0.004) and IL-2 (P<0.005) compared to the saline group (FIG. 8). With respect to HIV-specific T cell responses, the *rS. mitis* HIVEnv vaccines produced marked higher CD4 and CD8 T cell responses specific to the HIV envelope protein compared *rS. mitis* sham vaccine group. *rS. mitis* HIVEnv vaccinated mice generated higher frequency HIV Env-specific-CD4 T cell producing IFNγ (P<0.005), TNFα (P<0.02 and IL-2 (P<0.01) as well as HIV-specific-CD8 T cells producing IFNγ (P<0.009), TNFα (P<0.03) and IL-2 (P<0.002) compared to *rS. mitis* sham-immunized mice (FIG. 9). Interestingly, *rS. mitis* was capable of inducing CD8 T cell responses in mice, which were detected after in vitro stimulation with *S. mitis* lysate and full-length recombinant protein, which suggests that exogenous *S. mitis* and HIV Env antigens were processed for crosspriming of CD8 T cells (12,16). This proof of concept immunogenicity study shows that *rS. mitis* can induce *S. mitis*- and HIV-specific cellular immunity.

Example 2

Two candidate secretion/cell-wall anchored systems will be tested for the expression of the HIV inhibitor, T20. Both the serine-rich GspB-homologue or the pullulanase protein expressed in *S. mitis* will be tested. Both proteins contain an N-terminal signal peptide (YSIRK type) for secretion and the LPXTG motif for cell-wall surface expression. The signal peptide determinants for secretion of GspB into culture supernatants are the amino-terminal region (N), a hydrophobic core (H), a signal peptidase cleavage site (C), and the accessory Sec transport (AST). Interestingly, attachment of the signal peptide region but exclusion of the LPXTG sequence results in secretion of GspB in culture supernatants. Hence, *S. mitis* expressing HIV proteins on the cell wall surface will be constructed by flanking the viral protein with the signal peptide and the LPXTG anchor, and *S. mitis*-secreting HIV proteins or T20 inhibitor by attaching the signal peptide to the N-terminus.

A recombinant *S. mitis* secreting an HIV-1 inhibitor will be constructed as a microbicide since it was hypothesized that inhibiting HIV entry into oral mucosal target cells will be a viable approach for preventing mother-to-child transmission. Recombinant *S. mitis* secreting the potent HIV peptide inhibitor, T20, will be constructed. T20 is a 36-amino acid peptide (YTSLIHSLIEESQN-QQEKNEQELLELDKWASLWNWF (SEQ ID NO: 53)) that acts as a decoy α-helix and prevents HIV-1 infection by disrupting the assembly of the six-helix bundle viral fusion apparatus by mimicking the heptad repeat 2 (HR2) oligomerization domain of the gp41 envelope glycoprotein. T20 is clinically proven to inhibit a diversity of primary isolates of HIV-1 in humans. However, its delivery as a synthetic peptide is associated with high cost and inconvenient dosing regimen, making this drug a reserve in patients with drug resistant HIV. Delivery of this HIV inhibitor in the most cost-effective way will be highly beneficial, and the approach to accomplish this is to deliver the T20 inhibitor as an oral microbicide. Recombinant *S. mitis* secreting T20 which can be administered orally will be generated. The T20 peptide will be attached to N-terminal signal peptide of *S. mitis* pullulanase or GspB protein homologue, and an IgA1 protease cleavage site will be added to generate free T20 peptides. Engineered constructs will then be tested for the ability to secrete T20 that will inhibit HIV using the standard neutralization assay (Cayabyab M, Karlsson G B, Etemad-Moghadam B A, Hofmann W, Steenbeke T, Halloran M, Fanton J W, Axthelm M K, Letvin N L, Sodroski J G: Changes in human immunodeficiency virus type 1 envelope glycoproteins responsible for the pathogenicity of a multiply passaged simian-human immunodeficiency virus (SHIV-HXBc2). J Virol 1999, 73:976-984).

Example 3

Other commensal bacteria that encode a vaccine antigen can be generated by using the genbank sequences below for the construction of a DNA fragment containing erythromycin resistance cassette that is flanked by 250 bp pulA 5' and 3' fragments and ligating it into a suicide vector (pCR2.1) for transformation and integration at the pulA locus.

The genome of type strain *S. mitis* NCTC 12261 was sequenced and genbank numbers can be accessed via pubmed. The Genbank # of *S. mitis* sequence is as follows:

*Streptococcus mitis* NCTC 12261 contig1, whole genome shotgun sequence 113,379 bp linear DNA Accession: AEDX01000011.1GI:307615963 (SEQ ID NO: 55)

*Streptococcus mitis* NCTC 12261 contig2, whole genome shotgun sequence 24,459 bp linear DNA Accession: AEDX01000017.1GI:307615908 (SEQ ID NO: 56)

*Streptococcus mitis* NCTC 12261 contig3, whole genome shotgun sequence 81,409 bp linear DNA Accession: AEDX01000018.1GI:307615827 (SEQ ID NO: 57)

*Streptococcus mitis* NCTC 12261 contig4, whole genome shotgun sequence 314,111 bp linear DNA Accession: AEDX01000019.1GI:307615569 (SEQ ID NO: 58)

*Streptococcus mitis* NCTC 12261 contig5, whole genome shotgun sequence 100,480 bp linear DNA Accession: AEDX01000020.1GI:307615480 (SEQ ID NO: 59)

*Streptococcus mitis* NCTC 12261 contig6, whole genome shotgun sequence 91,167 bp linear DNA Accession: AEDX01000021.1GI:307615386 (SEQ ID NO: 60)

*Streptococcus mitis* NCTC 12261 contig7, whole genome shotgun sequence 84,457 bp linear DNA Accession: AEDX01000022.1GI:307615313 (SEQ ID NO: 61)

*Streptococcus mitis* NCTC 12261 contig8, whole genome shotgun sequence 111,153 bp linear DNA Accession: AEDX01000023.1GI:307615211 (SEQ ID NO: 62)

*Streptococcus mitis* NCTC 12261 contig9, whole genome shotgun sequence 112,014 bp linear DNA Accession: AEDX01000024.1GI:307615105 (SEQ ID NO: 63)

*Streptococcus mitis* NCTC 12261 contig10, whole genome shotgun sequence 88,437 bp linear DNA Accession: AEDX01000001.1GI:307616687 (SEQ ID NO: 64)

*Streptococcus mitis* NCTC 12261 contig11, whole genome shotgun sequence 93,022 bp linear DNA Accession: AEDX01000002.1GI:307616595 (SEQ ID NO: 65)

*Streptococcus mitis* NCTC 12261 contig12, whole genome shotgun sequence 71,904 bp linear DNA Accession: AEDX01000003.1GI:307616529 (SEQ ID NO: 66)

*Streptococcus mitis* NCTC 12261 contig13, whole genome shotgun sequence 164,416 bp linear DNA Accession: AEDX01000004.1GI:307616373 (SEQ ID NO: 67)

*Streptococcus mitis* NCTC 12261 contig14, whole genome shotgun sequence 75,285 bp linear DNA Accession: AEDX01000005.1GI:307616290 (SEQ ID NO: 68)

*Streptococcus mitis* NCTC 12261 contig15, whole genome shotgun sequence 16,944 bp linear DNA Accession: AEDX01000006.1GI:307616272 (SEQ ID NO: 69)

*Streptococcus mitis* NCTC 12261 contig16, whole genome shotgun sequence 112,411 bp linear DNA Accession: AEDX01000007.1GI:307616176 (SEQ ID NO: 70)

*Streptococcus mitis* NCTC 12261 contig17, whole genome shotgun sequence 22,040 bp linear DNA Accession: AEDX01000008.1GI:307616156 (SEQ ID NO: 71)

*Streptococcus mitis* NCTC 12261 contig18, whole genome shotgun sequence 124,845 bp linear DNA Accession: AEDX01000009.1GI:307616054 (SEQ ID NO: 72)

*Streptococcus mitis* NCTC 12261 contig19, whole genome shotgun sequence 2,436 bp linear DNA Accession: AEDX01000010.1GI:307616052 (SEQ ID NO: 73)

*Streptococcus mitis* NCTC 12261 contig20, whole genome shotgun sequence 8,218 bp linear DNA Accession: AEDX01000012.1GI:307615955 (SEQ ID NO: 74)

*Streptococcus mitis* NCTC 12261 contig21, whole genome shotgun sequence 5,961 bp linear DNA Accession: AEDX01000013.1GI:307615946 (SEQ ID NO: 75)

*Streptococcus mitis* NCTC 12261 contig22, whole genome shotgun sequence 4,520 bp linear DNA Accession: AEDX01000014.1GI:307615941 (SEQ ID NO: 76)

*Streptococcus mitis* NCTC 12261 contig23, whole genome shotgun sequence 3,240 bp linear DNA Accession: AEDX01000015.1GI:307615936 (SEQ ID NO: 77)

*Streptococcus mitis* NCTC 12261 contig24, whole genome shotgun sequence 4,773 bp linear DNA Accession: AEDX01000016.1GI:307615932 (SEQ ID NO: 78)

*Streptococcus mitis* NCTC 12261, whole genome shotgun sequencing project 1,831,081 bp other DNA. This entry is the master record for a whole genome shotgun sequencing project and contains no sequence data. Accession: NZ_AEDX00000000.1GI:307708845

*Streptococcus mitis* NCTC 12261, whole genome shotgun sequencing project 24 rc linear DNA. This entry is the master record for a whole genome shotgun sequencing project and contains no sequence data. Accession: AEDX00000000.1GI:307616765

The relevant teachings of all the references, patents and/or patent applications cited herein are incorporated herein by reference in their entirety.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (80 sequences)

SEQ ID NO: 1 - DNA, 27 bp, Mycobacterium tuberculosis
gacggctatgtcggcgcgcctgcccac

SEQ ID NO: 2 - protein, 9 aa, Mycobacterium tuberculosis
DGYVGAPAH

SEQ ID NO: 3 - DNA, 1260 bp, Mycobacterium tuberculosis
gtgatcgacggctggacggaagaacagcacgaacccaccgttaggcatgagcgcccagcagctccccaagacgttcggcgggtgatgttgctgggttcggccgaacccagccgggagctggcgatcgcgttgcagggcttgggcgcggaggtgatcgccgtcgacggctatgtcggcgcgcctgcccaccggatagccgaccagtcggtggtggtcaccatgaccgatgctgaagagctgacggcggtgatccggcggctgcaaccggatttcttggtgacggtcaccgccgcggtgtctgtggatgctctcgatgccgtcgagcaagccgacggcgagtgcactgagctggtgccgaacgcccgtgccgtccggtgcacggccgaccgggagggcctgcgccggctggccgccgatcagctcggcctgcccacagccccgttctggttcgtcggatcccttggcgaacttcaagcggtggccgtccatgctgggtttccgttgctggtgagcccggtggcaggggtggctggccagggtagctcggtggtcgccgggcccaacgaggtcgagcccgcctggcagcgcgcggcaggccatcaagtacagccgcagactgggggagtgagccctcgggtgtgcgccgagtcggtggtcgagatcgagtttttggtcaccatgatcgttgtgtgcagtcagggcccgaacgggccgctcatcgagttctgtgcacctatcggtcatcgcgacgccgatgccggtgagttggaatcctggcaaccgcagaagctgagcacggcggcgctggacgcggccaagtcgatcgccgcgcgcatcgtcaaggcgctcgggggacgcggggttttcggcgtcgaattgatgatcaacggcgatgaggtgtatttcgccgatgtcaccgtgtgtcctgccgggagtgcctgggtcaccgtgcgcagccagcggctttcggtgttcgaactgcaggcccgggcgatcctgggtctggcggtggacaccctgatgatctcgccgggtgccgcgcgggtgatcaacccggaccacacggcaggccgggcagcggtcggcgccgcaccacctgccgatgcgctgaccggtgcgctcggtgtgccggaaagcgacgtcgtgatattcggccgcgggcttggggtggcgctggccaccgcacccgaggtggcaatcgcccgcgaacgcgcccgcgaagttgcatctcggctaaatgtgccagactcacgcgagtga

SEQ ID NO: 4 - protein, 419 aa, Mycobacterium tuberculosis
MIDGWTEEQHEPTVRHERPAAPQDVRRVMLLGSAEPSRELAIALQGLGAEVIAVDGYVGAPAHRIADQSVVVTMTDAEELTAVIRRLQPDFLVTVTAAVSVDALDAVEQADGECTELVPNARAVRCTADREGLRRLAADQLGLPTAPFWFVGSLGELQAVAVHAGFPLLVSPVAGVAGQGSSVVAGPNEVEPAWQRAAGHQVQPQTGGVSPRVCAESVVEIEFLVTMIVVCSQGPNGPLIEFCAPIGHRDADAGELESWQPQKLSTAALDAAKSIAARIVKALGGRGVFGVELMINGDEVYFADVTVCPAGSAWVTVRSQRLSVFELQARAILGLAVDTLMISPGAARVINPDHTAGRAAVGAAPPADALTGALGVPESDVVIFGRGLGVALATAPEVAIARERAREVASRLNVPDSRE

SEQ ID NO: 5 - DNA, 39 bp, Mycobacterium bovis
cttgcggcggtggtgggcgtcgtcctggcgcaggtgttg

SEQ ID NO: 6 - protein, 13 aa, Mycobacterium bovis
LAAVVGVVLAQVL

SEQ ID NO: 7 - DNA, 1050 bp, Mycobacterium bovis
atgctcttcgcggccctgcgtgacatgcaatggagaaagcgccgcctggtcatcacgatcatcagcaccgggctgatcttcgggatgacgcttgttttgaccggactcgcgaacggcttccgggtggaggcccggcacaccgtcgattccatgggtgtcgatgtattcgtcgtcagatccggcgctgctggaccttttctgggttcaataccgtttcccgatgttgacctggcccgagtggccgctgaacccggtgtcatggccgcggccccgttgggcagcgtggggacgatcatgaaagaaggcacgtcgacgcgaaacgtcacggtcttcggcgcgcccgagcacggacctggcatgccacgggtctcagagggtcggtcaccgtcgaaaccggacgaagtcgcggcatcgagcacgatgggccgacacctcggtgacactgtcgaggtcggcgcgcgcagattgcgggtcgttggcattgtgccgaattccaccgcgctggccaagatccccaatgtcttcctcacgaccgagggcttacagaaattggcgtacaacgggcagccgaatatcacgtccatcgggatcataggtatgccccgacagctgccggagggttaccagactttcgatcgggtgggcgctgtcaatgatttggtgcgcccattgaaggtcgcagtgaattcgatctcgatcgtggctgttttgctgtggattgtggcggtgctgatcgtcggctcggtggtgtacctttcggctcttgagcggctacgtgacttcgcggtgttcaaggcgattggcacgccaacgcgctcgattatggccgggctcgcattacaggcgctggtcattgcgttgcttgcggcggtggtgggcgtcgtcctggcgcaggtgttggcaccactgtttccgatgattgtcgcggtacccgtcggtgcttacctggcgctaccggtggccgcgatcgtcatcggtctgttcgctagtgttgccggattgaagcgcgtggtgacggtcgatcccgcgcaggcgttcggaggtccctag

SEQ ID NO: 8 - protein, 349 aa, Mycobacterium bovis
MLFAALRDMQWRKRRLVITIISTGLIFGMTLVLTGLANGFRVEARHTVDSMGVDVFVVRSGAAGPFLGSIPFPDVDLARVAAEPGVMAAAPLGSVGTIMKEGTSTRNVTVFGAPEHGPGMPRVSEGRSPSKPDEVAASSTMGRHLGDTVEVGARRLRVVGIVPNSTALAKIPNVFLTTEGLQKLAYNGQPNITSIGIIGMPRQLPEGYQTFDRVGAVNDLVRPLKVAVNSISIVAVLLWIVAVLIVGSVVYLSALERLRDFAVFKAIGTPTRSIMAGLALQALVIALLAAVVGVVLAQVLAPLFPMIVAVPVGAYLALPVAAIVIGLFASVAGLKRVVTVDPAQAFGGP

SEQ ID NO: 9 - DNA, 27 bp, Mycobacterium tuberculosis
cgctccggcgcggccacacccgttcgc

SEQ ID NO: 10 - protein, 9 aa, Mycobacterium tuberculosis
RSGAATPVR

SEQ ID NO: 11 - DNA, 171 bp, Mycobacterium tuberculosis
gtgccggccgctccgtcgacaagagagaaggactgcatgctggttttgcacggcttctggtccaactccggcgggatgcggctgtgggcggaggactccgatctgctggtgaagagcccgagtcaggcgctgcgctccggcgcggccacacccgttcgcggcgcccgctga

SEQ ID NO: 12 - protein, 56 aa, Mycobacterium tuberculosis
MPAAPSTREKDCMLVLHGFWSNSGGMRLWAEDSDLLVKSPSQALRSGAATPVRGAR

SEQ ID NO: 13 - DNA, 21 bp, Mycobacterium tuberculosis
acctgcctcccattcgcacta

SEQ ID NO: 14 - protein, 7 aa, Mycobacterium tuberculosis
TCLPFAL

SEQ ID NO: 15 - DNA, 267 bp, Mycobacterium tuberculosis
atgtccgcgccacccgctcaagcgccggtatgtggcgccttggcggctaggccaaccgcccccggcaacgccagctgcacacgcccagcgaagcgcgattgtcggtacgggtcgcgctgcgaaacctgcctcccattcgcactagcaaaagactgtcgacaagcgagcagtcgacttcaggccgcgaccgaacccgacgagacgacaacaacatctgtcatctcaatgcgctcaccaggatcgctacaatatcagccagctacatga

SEQ ID NO: 16 - protein, 88 aa, Mycobacterium tuberculosis
MSAPPAQAPVCGALAARPTAPGNASCTRPAKRDCRYGSRCETCLPFALAKDCRQASSRLQAATEPDETTTTSVISMRSPGSLQYQPAT

SEQ ID NO: 17 - DNA, 24 bp, Mycobacterium bovis
acgaccatgccgctgttcgccgac

SEQ ID NO: 18 - protein, 8 aa, Mycobacterium bovis
TTMPLFAD

SEQ ID NO: 19 - DNA, 492 bp, Mycobacterium bovis
gtgccagaggtcacccgtgaagaaccggcaatcgatggatggttcaccaccgataaggccggcaacccgcatctgctcggcggcaagtgtccccagtgcggcacgtacgtcttcccaccccgggcggacaattgtccgaatccggcttgcggcagcgacacactagagtcggtcggactgtcgacccgcggaaagctttggagctacaccgaaaaccggtacgccccgccaccgccgtacccggcacccgacccctttgagccgtttgccgtggccgcggtggaactggccgacgagggactgatcgtgctgggcaaagtggtcgatggcacgctggccgccgatctgaaggtcggcatggagatggagctgacgaccatgccgctgttcgccgacgacgacggtgtgcagcgcatcgtctacgcgtggcggatcccatcgcgcgccggcgacgatgcagagcgcagcgatgctgaggagcggcgccgatga

SEQ ID NO: 20 - protein, 163 aa, Mycobacterium bovis
MPEVTREEPAIDGWFTTDKAGNPHLLGGKCPQCGTYVFPPRADNCPNPACGSDTLESVGLSTRGKLWSYTENRYAPPPPYPAPDPFEPFAVAAVELADEGLIVLGKVVDGTLAADLKVGMEMELTTMPLFADDDGVQRIVYAWRIPSRAGDDAERSDAEERRR

SEQ ID NO: 21 - DNA, 141 bp, Mycobacterium bovis
gtgctggtcgcactggccgcgctgggcacccaaccgtggcaggacttcgcagagcaggaaaccgccgggctggccatcatcttggacaacgtcacgcatggcgaatgggccagcacgattctggccgccggtgcggtggtc

SEQ ID NO: 22 - protein, 47 aa, Mycobacterium bovis
VLVALAALGTQPWQDFAEQETAGLAIILDNVTHGEWASTILAAGAVV

SEQ ID NO: 23 - DNA, 1431 bp, Mycobacterium bovis
ttgccgacaacgtcgatgagccttcgagaactgatgctgcggcgccgcccggtgagcggcgccccggtcgcatccggggcatcggggaacctcaagcggagtttcggcaccttccagctgaccatgttcggggttggcgcgacgataggtaccggcatctttttcgtgcttgcccaggcagttccagaggccggcccgggcgtgattgtttcgttcatcatcgccggcatcgccgctgggctcgcggctatctgctacgcggaactggcttccgccgtgccgatttccgggtcggcgtactcctacgcgtacacgacgctgggcgaggcggtcgcgatggtggtggcggcctgcctactgctggaatacggggtagccaccgcagcggtcgcggtcggctggagtggctacgtgaacaagctgctgagtaatctgttcggatttcagatgccgcacgtattgtcggcggcgccgtgggacacccatcccggttgggtgaacctgcccgccgtcatcctgatcgggctatgcgcgctgctgttgattcgaggggccagcgagtcggcgagggtcaacgcgatcatggtgctgatcaagctcggcgtgctgggcatgttcatgatcatcgcgttcagcgcgtacagcgccgaccacctcaaggatttcgtcccattcggcgtcgccggcatcggctccgcggcgggcacgatcttcttctcatacatcggccttgacgcggtgtcgaccgccggcgacgaggtgaaggacccgcagaagaccatgccgcgtgcgctgatcgcagcgctggtggtcgtcaccggtgtctacgtgctggtcgcactggccgcgctgggcacccaaccgtggcaggacttcgcagagcaggaaaccgccgggctggccatcatcttggacaacgtcacgcatggcgaatgggccagcacgattctggccgccggtgcggtggtctcgattttcaccgtcacgctggtcaccatgtacggccagacccggatcctgttcgcgatggggcgcgacgggctgctgccggcgcggttcgcgaaggtgaatccgcgcaccatgacgccggtgcacaacacggtgatcgtcgcgatcttcgcatcgacgctggccgccttcataccgctggatagcttggcggacatggtgtccatcggcacgctcaccgcgttcagcgtggtggctgtgggtgtgatcgttctacgggtgcgcgagcccgacttaccccgagggttcaaggtacccggttaccctgtgacgcctgttctttcggtgctggcctgcgggtatatcctggccagcttgcactggtacacctggctggcgttcagcggatgggtggcggtggcagtgatcttttacctgatgtggggtcggcaccacagtgcgctcaacgaggaagtgccgtga

SEQ ID NO: 24 - protein, 476 aa, Mycobacterium bovis
MPTTSMSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 25 - DNA, 54 bp, Mycobacterium tuberculosis
tgcgcggtggtgctggccaccatgccgccgctgctttcggcgatcgccaacgca

SEQ ID NO: 26 - protein, 18 aa, Mycobacterium tuberculosis
CAVVLATMPPLLSAIANA

SEQ ID NO: 27 - DNA, 1974 bp, Mycobacterium tuberculosis
atgaccttgaccgcttgtgaagtaactgccgcggaggctcctttcgaccgcgtttcaaagaccattccccacccattgagctggggagccgcgctgtggtcggtagtctccgtgcgctgggccaccgtggcgctgctgctgtttctcgccggactagtggcgcaactgaacggtgctcccgaggccatgtggtggacgctttacctggcctgttatctggccggcggctggggctcggcatgggcgggcgcacaagcgttgcggaacaaggcacttgatgtggatctgctgatgattgccgcggcggtcggagcggtcgcgattgggcagatcttcgacggcgcgctgctgatcgtgatcttcgccacgtccggtgcgctggatgacattgccaccagacacaccgcggaatcggtcaaaggcctgctggacctcgcgccggatcaggcggtggtggtccagggcgacggcagcgaacgggtggtggcggccagcgagctggtggtgggggaccgggtggtggtgcggccgggggaccggatacccgcagacggtgcggtgctgtcgggggctagcgacgtcgaccaacgctcgatcaccggtgaatcgatgccggtggccaaggcccgcggtgacgaggtgttcgccggcaccgtgaacggatcgggtgtattgcatctggtggtcacccgtgacccgagccagaccgtggtagcccgcatcgtcgaactggtcgccgacgcttcggcgacgaaggccaaaacccaactgttcattgagaaaatcgagcaacgctactccctgggcatggtcgcggccacccttgccctcatcgttattccgctgatgttcggcgccgacctgcggccggtgctgctgcgcgccatgaccttcatgatcgtggcatcgccatgcgcggtggtgctggccaccatgccgccgctgctttcggcgatcgccaacgcaggccgtcatggggtgctggtcaaatccgcggtggtcgtcgaacgcctggccgataccagcatcgtcgctttggacaagaccggtacgctgacccgtggcatcccgcgactggcttccgtcgcaccgctggaccccaacgtggtcgatgcccggcgattgttgcaattggcagctgccgcagaacaatccagcgagcacccgcttggccgggcgatcgtcgcggaagctcgtcggcgtggtatcgccataccgcccgccaaggacttccgcgcggtcccgggctgcggggtccacgccctggtgggcaacgatttcgtcgagatcgccagcccgcaaagctaccgcggtgcaccgctagcagagctggcgccgctcctttctgccggcgccactgccgccatcgtcttgttggatggagttgccatcggtgtgctcgggctcaccgatcagcttcgtccggatgccgtggagtccgtcgcggcgatggctgcattgaccgccgcaccaccggtgctgctcacgggtgacaacgggcgagcggcttggcgggtcgctcggaacgccgggatcaccgatgtgcgagccgcattgctgcccgagcagaaggttgaagtcgtgcgcaacctgcaggccggtggtcaccaggtgctgctcgtcggcgacggcgtcaacgacgctcccgccatggccgccgcccgcgccgctgtcgccatgggcgccggcgccgatctgaccctacagaccgcagacggggtgaccatacgggacgaactgcacaccatcccgacgatcatcgggttggcacggcaggcgcgccgggtggtcaccgtcaacctggccatcgcggccaccttcatcgccgtcctggtgctgtgggacctttttgggcagctgccgctgccactgggtgtggtgggtcacgaagggtccactgtgctggtggccctcaacggcatgcggctattgaccaaccggtcgtggcgggccgcggcttcggctgcgcgttag

SEQ ID NO: 28 - protein, 657 aa, Mycobacterium tuberculosis
MTLTACEVTAAEAPFDRVSKTIPHPLSWGAALWSVVSVRWATVALLLFLAGLVAQLNGAPEAMWWTLYLACYLAGGWGSAWAGAQALRNKALDVDLLMIAAAVGAVAIGQIFDGALLIVIFATSGALDDIATRHTAESVKGLLDLAPDQAVVVQGDGSERVVAASELVVGDRVVVRPGDRIPADGAVLSGASDVDQRSITGESMPVAKARGDEVFAGTVNGSGVLHLVVTRDPSQTVVARIVELVADASATKAKTQLFIEKIEQRYSLGMVAATLALIVIPLMFGADLRPVLLRAMTFMIVASPCAVVLATMPPLLSAIANAGRHGVLVKSAVVVERLADTSIVALDKTGTLTRGIPRLASVAPLDPNVVDARRLLQLAAAAEQSSEHPLGRAIVAEARRRGIAIPPAKDFRAVPGCGVHALVGNDFVEIASPQSYRGAPLAELAPLLSAGATAAIVLLDGVAIGVLGLTDQLRPDAVESVAAMAALTAAPPVLLTGDNGRAAWRVARNAGITDVRAALLPEQKVEVVRNLQAGGHQVLLVGDGVNDAPAMAAARAAVAMGAGADLTLQTADGVTIRDELHTIPTIIGLARQARRVVTVNLAIAATFIAVLVLWDLFGQLPLPLGVVGHEGSTVLVALNGMRLLTNRSWRAAASAAR

SEQ ID NO: 29 - DNA, 27 bp, Mycobacterium tuberculosis
atggtgatcatagagctgatgcgccgg

SEQ ID NO: 30 - protein, 9 aa, Mycobacterium tuberculosis
MVIIELMRR

SEQ ID NO: 31 - DNA, 996 bp, Mycobacterium tuberculosis
atggtgatcatagagctgatgcgccgggtggtaggtctcgcacagggagctaccgccgaggtcgccgtctatggcgaccgagatcgtgatctcgcggagcgatggtgcgcgaacaccggaaacaccctggtgcgcgccgacgtggaccagaccggcgtcggcaccctggtggtgcgccgcggccatccgcctgacccggcaagcgtgttgggccccgaccggctacccggggtccggttgtggctgtacaccaacttccactgcaacctgtgctgcgactactgctgcgtctcgtcgtcaccaagcaccccgcatcgcgaactgggggcggagcggatcggccgaatcgtcggtgaagcggcgcgctggggagtgcgcgaactgttcctcaccggcggtgagccgttcctgctgcccgacatcgacacgatcatcgcgacctgtgtgaagcagttgcccaccaccgtcctcaccaacggcatggtgttcaaagggcggggtcggcgcgcgctggaatccctacctagagggctcgccttgcagatcagcctggactcggccaccccggagctgcacgatgcgcaccgcggcgcggggacgtgggtcaaggcagtagctggtatccggttggcgctctcacttggcttccgggtgcgggtggccgcgacggttgccagccccgcacctggcgagctgacggcgtttcacgacttcctcgacgggcttggcatcgcacccggggatcagctggtccggccgatcgcgctggagggcgccgcgtcgcaaggggtggcgctcacccgcgaatcgctggttcccgaggtgaccgtcaccgccgacggcgtgtactggcacccagtggccgccaccgacgagcgcgccctggtcacccgtaccgtcgaacccttgaccccggcgctggacatggtaagccggctattcgccgaacagtggacacgagccgccgaagaggccgcgttgttcccgtgtgcgtag

SEQ ID NO: 32 - protein, 331 aa, Mycobacterium tuberculosis
MVIIELMRRVVGLAQGATAEVAVYGDRDRDLAERWCANTGNTLVRADVDQTGVGTLVVRRGHPPDPASVLGPDRLPGVRLWLYTNFHCNLCCDYCCVSSSPSTPHRELGAERIGRIVGEAARWGVRELFLTGGEPFLLPDIDTIIATCVKQLPTTVLTNGMVFKGRGRRALESLPRGLALQISLDSATPELHDAHRGAGTWVKAVAGIRLALSLGFRVRVAATVASPAPGELTAFHDFLDGLGIAPGDQLVRPIALEGAASQGVALTRESLVPEVTVTADGVYWHPVAATDERALVTRTVEPLTPALDMVSRLFAEQWTRAAEEAALFPCA

SEQ ID NO: 33 - DNA, 57 bp, Mycobacterium tuberculosis
cgtgccaccgcagaccagatcggcacgcagacaacgcaaatcgcggccatcaaagcc

SEQ ID NO: 34 - protein, 19 aa, Mycobacterium tuberculosis
RATADQIGTQTTQIAAIKA

SEQ ID NO: 35 - DNA, 1140 bp, Mycobacterium tuberculosis
atgacgatctccgatgtacccacccagacgctgcccgccgaaggcgaaatcggcctgatagacgtcggctcgctgcaactggaaagcggggcggtgatcgacgatgtctgtatcgccgtgcaacgctggggcaaattgtcgcccgcacgggacaacgtggtggtggtcttgcacgcgctcaccggcgactcgcacatcactggacccgccggacccggccaccccacccccggctggtgggacggggtggccgggccgagtgcgccgattgacaccacccgctggtgcgcggtagctaccaatgtgctcggcggctgccgcggctccaccgggcccagctcgcttgcccgcgacggaaagccttggggctcaagatttccgctgatctcgatacgtgaccaggtgcaggcggacgtcgcggcgctggccgcgctgggcatcaccgaggtcgccgccgtcgtcggcggctccatgggcggcgcccgggccctggaatgggtggtcggctacccggatcgggtccgagccggattgctgctggcggtcggtgcgcgtgccaccgcagaccagatcggcacgcagacaacgcaaatcgcggccatcaaagccgacccggactggcagagcggcgactaccacgagacggggagggcaccagacgccgggctgcgactcgcccgccgcttcgcgcacctcacctaccgcggcgagatcgagctcgacacccggttcgccaaccacaaccagggcaacgaggatccgacggccggcgggcgctacgcggtgcaaagttatctggaacaccaaggagacaaactgttatcccggttcgacgccggcagctacgtgattctcaccgaggcgctcaacagccacgacgtcggccgcggccgcggcggggtctccgcggctctgcgcgcctgcccggtgccggtggtggtgggcggcatcacctccgaccggctctacccgctgcgcctgcagcaggagctggccgacctgctgccgggctgcgccgggctgcgagtcgtcgagtcggtctacggacacgacggcttcctggtggaaaccgaggccgtgggcgaattgatccgccagacactgggattggctgatcgtgaaggcgcgtgtcggcggtga

SEQ ID NO: 36 - protein, 379 aa, Mycobacterium tuberculosis
MTISDVPTQTLPAEGEIGLIDVGSLQLESGAVIDDVCIAVQRWGKLSPARDNVVVVLHALTGDSHITGPAGPGHPTPGWWDGVAGPSAPIDTTRWCAVATNVLGGCRGSTGPSSLARDGKPWGSRFPLISIRDQVQADVAALAALGITEVAAVVGGSMGGARALEWVVGYPDRVRAGLLLAVGARATADQIGTQTTQIAAIKADPDWQSGDYHETGRAPDAGLRLARRFAHLTYRGEIELDTRFANHNQGNEDPTAGGRYAVQSYLEHQGDKLLSRFDAGSYVILTEALNSHDVGRGRGGVSAALRACPVPVVVGGITSDRLYPLRLQQELADLLPGCAGLRVVESVYGHDGFLVETEAVGELIRQTLGLADREGACRR

SEQ ID NO: 37 - DNA, 57 bp, Mycobacterium tuberculosis
cgcaccgccgaggaacgcgccaacgcggttcgcgggcgggccgattcgctgcgccgt

SEQ ID NO: 38 - protein, 19 aa, Mycobacterium tuberculosis
RTAEERANAVRGRADSLRR

SEQ ID NO: 39 - DNA, 3618 bp, Mycobacterium tuberculosis
gtgtacctcaagagtctgacgttgaagggcttcaagtccttcgccgcgccgacgactttacgcttcgagccgggcattacggccgtcgttgggcccaacggctccggcaaatccaatgtggtcgatgccctggcgtgggtgatgggggagcagggggcaaagacgctgcgcggcggcaagatggaagacgtcatcttcgccggcacctcgtcgcgtgcgccgctgggccgcgccgaagtcaccgttagcatcgacaactccgacaacgcactgcctatcgaatacaccgaggtgtcgatcacccgaagaatgtttcgcgacggtgccagcgaatacgaaatcaacggcagcagttgccgtttgatggatgtgcaggagttgctgagcgactccggcatcggccgtgagatgcatgtgattgttgggcaagggaagctcgaggagatcttgcagtcgcggcctgaggatcggcgggcgttcatcgaggaagccgccggtgtgctcaagcatcgcaagcgcaaggaaaaagctctgcgcaaactcgacacgatggcggcgaacctggcccggctcaccgatctgaccaccgagctccggcgtcaactcaaaccgctgggccggcaggccgaggcggcccagcgtgccgcggccatccaagccgatctgcgcgacgcccggctgcgcctggcggccgacgacttggtaagccgcagagccgaacgggaagcggtctttcaggccgaggctgcgatgcgccgcgagcatgacgaggccgccgcccggctggcggtggcatccgaggagctggccgcgcatgagtccgcggtcgccgaactctcgacgcgggccgagtcgatccagcacacttggttcgggctgtctgcgctggccgaacgggtggacgctacggtgcgcatcgccagcgaacgcgcccatcatctcgatatcgagccggtagcggtcagcgacaccgaccccagaaagcccgaggagctagaagccgaggcccagcaggtggccgtcgccgagcaacaactgttagcggagctggacgcggcgcgtgcccgactcgatgctgcccgtgcagagctggccgaccgggagcgccgcgccgccgaggccgaccgggcacacctggcggcggtccgggaggaggcggaccgccgtgagggactggcgcggctggctggccaggtggagaccatgcgggcgcgtgtcgaatcgatcgatgagagcgtggcacggttgtccgagcggatcgaggatgccgcaatgcgcgcccagcagacccgagccgagttcgaaaccgtgcagggccgcatcggtgaactggatcaaggcgaggtcggcctggatgagcaccacgagcgtactgtggccgcgttgcggttggccgacgaacgcgtcgccgagctgcaatccgccgaacgcgccgccgaacgccaggtggcatcgctacgggctcgcatcgatgcgctcgcagtggggctacagcgcaaggacggcgcggcgtggctggcgcacaatcgcagtggcgcagggcttttcggttcgatcgcccaattggtgaaggtacgttccggctatgaagcggcactggccgcggcgctcgggccggcggccgacgcacttgcggtggacggcctgactgccgcgggtagtgccgtcagcgcactcaaacaagccgacggcggtcgcgcggtcctcgtgctgagtgactggccggccccgcaagccccccaatccgcctcgggggagatgctgcctagcggcgcccagtgggccctagacctggtcgagtctccaccgcagttggttggcgcgatgatcgccatgctttcgggtgtcgcggtggtcaacgacctgactgaggcaatgggcctggtcgagattcgtccggagctacgcgcggtcaccgttgacggtgatctggtgggcgccggctgggtcagcggcggatcggaccgcaagctgtccaccttggaggtcacctccgagatcgacaaggccaggagtgagctggccgctgccgaggcgctggcggcgcaattgaatgcggccctggccggtgcgctgaccgagcagtccgcccgccaggacgcggccgagcaagccttggccgcgcttaacgaatccgacacggccatctcggcgatgtacgagcagctgggccgcctcgggcaggaggcccgcgcggcggaagaagagtggaaccggttgctgcagcagcgtacggaacaggaagccgtgcgcacacagactctcgacgacgtcatacaacttgagacccagctgcgtaaggcccaggagacccaacgggtgcaggtggcccaaccgatcgaccgccaggcgatcagtgccgctgccgatcgcgcccgcggtgtcgaagtggaagcccggctggcggtgcgcaccgccgaggaacgcgccaacgcggttcgcgggcgggccgattcgctgcgccgtgcggcagcggcggaacgtgaggcgcgggtgcgggctcagcaagcacgcgccgcaagactgcatgcggccgcggtggccgcagcggtcgccgactgcggacggctgctggccgggcggttgcaccgggcggtggacggggcgtcgcaactgcgcgacgcgtcggccgcgcaacgtcagcagcggttagcggcgatggccgcggtgcgcgacgaggtgaacacgctgagcgcccgagtgggggaactcaccgattcgctgcaccgcgacgagctggctaacgcgcaggcggcgctgcgtatcgagcagcttgagcagatggtgctagagcagttcggaatggcgccggccgacttgatcaccgaatacggtccacatgtggcgctaccaccgaccgagctcgagatggctgagttcgagcaagcccgcgaacgcggcgagcaggtgattgcgcccgcccccatgccgttcgaccgggttacccaggagcgccgggccaaacgcgccgagcgtgcgcttgccgagttgggcagggtcaacccgctggcgctcgaagagtttgctgccttggaggagcgctacaatttcctgtccacccaactcgaggatgtcaaggctgcccgcaaggatctgctgggcgtcgtcgccgatgttgacgcccgcatcctgcaggtgttcaatgacgcgttcgtagacgtggaacgcgaatttcgcggcgtgttcaccgcattgttccccggtggtgaaggacggctgcggctgaccgagcccgacgacatgctcaccaccggcatcgaggtcgaagcccgcccgccgggcaagaagattacccgactgtctttgctctccggtggcgagaaggcgctgaccgcggtggcgatgctggtcgcgatctttcgtgcccgtccatcgccgttctacatcatggacgaggtggaggccgccctcgacgacgtgaacctgcgccgactgctcagcctgttcgaacagctgcgagagcagtcgcagatcatcatcatcacccaccagaagccgacgatggaggtcgcggacgcactgtacggcgtaaccatgcagaacgacggcatcaccgcggtcatctcgcagcgcatgcgcggtcagcaggtggatcagctggttaccaattcctcgtag

SEQ ID NO: 40 - protein, 1205 aa, Mycobacterium tuberculosis
MYLKSLTLKGFKSFAAPTTLRFEPGITAVVGPNGSGKSNVVDALAWVMGEQGAKTLRGGKMEDVIFAGTSSRAPLGRAEVTVSIDNSDNALPIEYTEVSITRRMFRDGASEYEINGSSCRLMDVQELLSDSGIGREMHVIVGQGKLEEILQSRPEDRRAFIEEAAGVLKHRKRKEKALRKLDTMAANLARLTDLTTELRRQLKPLGRQAEAAQRAAAIQADLRDARLRLAADDLVSRRAEREAVFQAEAAMRREHDEAAARLAVASEELAAHESAVAELSTRAESIQHTWFGLSALAERVDATVRIASERAHHLDIEPVAVSDTDPRKPEELEAEAQQVAVAEQQLLAELDAARARLDAARAELADRERRAAEADRAHLAAVREEADRREGLARLAGQVETMRARVESIDESVARLSERIEDAAMRAQQTRAEFETVQGRIGELDQGEVGLDEHHERTVAALRLADERVAELQSAERAAERQVASLRARIDALAVGLQRKDGAAWLAHNRSGAGLFGSIAQLVKVRSGYEAALAAALGPAADALAVDGLTAAGSAVSALKQADGGRAVLVLSDWPAPQAPQSASGEMLPSGAQWALDLVESPPQLVGAMIAMLSGVAVVNDLTEAMGLVEIRPELRAVTVDGDLVGAGWVSGGSDRKLSTLEVTSEIDKARSELAAAEALAAQLNAALAGALTEQSARQDAAEQALAALNESDTAISAMYEQLGRLGQEARAAEEEWNRLLQQRTEQEAVRTQTLDDVIQLETQLRKAQETQRVQVAQPIDRQAISAAADRARGVEVEARLAVRTAEERANAVRGRADSLRRAAAAEREARVRAQQARAARLHAAAVAAAVADCGRLLAGRLHRAVDGASQLRDASAAQRQQRLAAMAAVRDEVNTLSARVGELTDSLHRDELANAQAALRIEQLEQMVLEQFGMAPADLITEYGPHVALPPTELEMAEFEQARERGEQVIAPAPMPFDRVTQERRAKRAERALAELGRVNPLALEEFAALEERYNFLSTQLEDVKAARKDLLGVVADVDARILQVFNDAFVDVEREFRGVFTALFPGGEGRLRLTEPDDMLTTGIEVEARPPGKKITRLSLLSGGEKALTAVAMLVAIFRARPSPFYIMDEVEAALDDVNLRRLLSLFEQLREQSQIIIITHQKPTMEVADALYGVTMQNDGITAVISQRMRGQQVDQLVTNSS

SEQ ID NO: 41 - DNA, 48 bp, Mycobacterium tuberculosis
ctgcacgcgcagaaggcgctgctggtgtggctgctggagcgctcatga

SEQ ID NO: 42 - protein, 16 aa, Mycobacterium tuberculosis
RLHAQKALLVWLLERS

SEQ ID NO: 43 - DNA, 924 bp, Mycobacterium tuberculosis
gtgatcaggcatttcctgcgcgacgacgatctgtccccggccgaacaggccgaggtgctcgagctcgcggccgagctgaagaaagacccggttagccgtcgtcccctgcaagggccgcgcggggtggcggtcatcttcgacaagaactccacccgcacccggttctccttcgagctgggcatcgcgcagctgggcgggcatgccgtcgtcgtcgacagcggcagcacccagctgggccgcgacgaaaccctgcaggacaccgcaaaggtgttgtcccgctacgtcgatgccatcgtctggcgaaccttcggccaagagcggctggacgccatggcgtcggtcgcgacggtgcccgtgatcaacgcgctctccgatgagttccatccgtgtcaggtgttggccgacctgcagaccatcgccgaacgcaagggggcgctgcgcggcctgaggttgtcctacttcggcgacggcgccaacaacatggcccactcgctgctgctcggcggggtcaccgcgggtatccacgtcaccgtcgcggctcccgagggcttcctgcccgacccgtcggtgcgggccgcggccgagcgccgcgcccaggataccggcgcctcggtgactgtgaccgccgacgcccacgcggccgccgccggcgccgacgttctggtcaccgacacctggacgtcgatgggccaggaaaacgacgggttggaccgagtgaagccgtttcggccgtttcagctcaactcgcgacttctggcgctggccgactcggatgccatcgtgttgcattgcctgccggcccatcgcggcgacgagatcaccgacgcggtgatggacgggccggccagcgcggtgtgggacgaggccgaaaaccggctgcacgcgcagaaggcgctgctggtgtggctgctggagcgctcatga

SEQ ID NO: 44 - protein, 307 aa, Mycobacterium tuberculosis
MIRHFLRDDDLSPAEQAEVLELAAELKKDPVSRRPLQGPRGVAVIFDKNSTRTRFSFELGIAQLGGHAVVVDSGSTQLGRDETLQDTAKVLSRYVDAIVWRTFGQERLDAMASVATVPVINALSDEFHPCQVLADLQTIAERKGALRGLRLSYFGDGANNMAHSLLLGGVTAGIHVTVAAPEGFLPDPSVRAAAERRAQDTGASVTVTADAHAAAAGADVLVTDTWTSMGQENDGLDRVKPFRPFQLNSRLLALADSDAIVLHCLPAHRGDEITDAVMDGPASAVWDEAENRLHAQKALLVWLLERS

SEQ ID NO: 45 - DNA, 66 bp, Mycobacterium tuberculosis
cgctggaccgacgaaaccttcggcgacatcggcggcgccggcggcggcgtgagcggacatcgcggg

SEQ ID NO: 46 - protein, 22 aa, Mycobacterium tuberculosis
RWTDETFGDIGGAGGGVSGHRG

SEQ ID NO: 47 - DNA, 765 bp, Mycobacterium tuberculosis
atgagcggcgagacaaccaggctgaccgaaccgcaactacgtgagctggccgcgcgcggagctgccgaactcgacggcgccaccgccaccgacatgttgcgctggaccgacgaaaccttcggcgacatcggcggcgccggcggcggcgtgagcggacatcgcgggtggacaacgtgcaactacgtagttgcttccaacatggctgatgcggtgctggtggatctggccgccaaggtgcgaccgggcgtaccggtcatctttcttgataccggctaccacttcgtcgaaacaatcggcaccagagatgcgatcgagtccgtctatgacgtccgggtgctcaatgtcactccggagcacacagtggccgagcaggacgaactgctgggcaaggacttgttcgcccgcaacccccatgaatgctgccggttgcgcaaggtcgttcccctgggcaagacgctgcgtggctactccgcgtgggtgaccgggctacggcgggtcgatgcaccgacccgggccaatgccccgctggtcagcttcgatgagacgttcaaactagtgaaggtcaacccgctggcggcgtggaccgaccaagatgtgcaggaatacattgccgacaacgacgtgctggttaatccgcttgtgcgggaaggctatccgtcgatcggttgcgctccgtgcacagccaaacccgccgaaggcgccgacccgcgcagcggacgctggcaggggctggccaagaccgaatgcgggttgcacgcctcgtga

SEQ ID NO: 48 - protein, 254 aa, Mycobacterium tuberculosis
MSGETTRLTEPQLRELAARGAAELDGATATDMLRWTDETFGDIGGAGGGVSGHRGWTTCNYVVASNMADAVLVDLAAKVRPGVPVIFLDTGYHFVETIGTRDAIESVYDVRVLNVTPEHTVAEQDELLGKDLFARNPHECCRLRKVVPLGKTLRGYSAWVTGLRRVDAPTRANAPLVSFDETFKLVKVNPLAAWTDQDVQEYIADNDVLVNPLVREGYPSIGCAPCTAKPAEGADPRSGRWQGLAKTECGLHAS

SEQ ID NO: 49 - DNA, 108 bp, Human immunodeficiency virus
tatacatcactcattcactcactcatcgaagaatcacaaaatcagcaggaaaaaaacgaacaagaattattagaattagacaaatgggcatcactttggaattggttt

SEQ ID NO: 50 - protein, 36 aa, Human immunodeficiency virus
YTSLIHSLIEESQNQQEKNEQELLELDKWASLWNWF

SEQ ID NO: 51 - DNA, 1716 bp, Artificial Sequence
  Fusion construct between Streptococcus mitis pulA gene and Human immunodeficiency virus gp120 gene
atggtctacagcatccgttccctcaaaaatggaactggttctgtccttattggagcaagccttattctgcttgccatggctacaccaactatctcagcaaacgaaaatacaccaaccactaacgaacccagcaacagaaatacgacctcccttactcaacctcttactgatgcaacaaacatcgctggcaagaacgaaagcgatttttcttcacccgatagtgcaaacgcttccgcaactacaacccttttttgcgcttcagacgccaaagcttacgatactgaagtccataatgtctgggctacgcatgcctgtgtacctactgaccctaacccacaagaagtcgtactagtaaatgtcaccgagaatttcaatatgtggaagaatgatatggtggagcaaatgcacgaagatatcatcagtttatgggatcaaagcttaaaaccttgtgtcaaactcaccccattatgtgtctctctcaaatgcacagatctaaaaaacgataccaacactaactcatcatctggaagaatgattatggaaaaaggagaaattaaaaattgtagttttaacatcagcacatctattcgcggtaaagtacaaaaagaatacgcatttttttataaacttgatattatcccaatcgacaatgatacaactagttactcacttacgtcttgtaatacctcagtcattacccaagcttgtccaaaagtaagttttgaaccaattccaattcattattgcgcaccagccgggtttgctattttaaaatgtaataataaaaccttcaatggcacaggtccttgtacaaatgtttcaaccgtccaatgtactcacggtattcgtccagtcgtcagcacacaactcttacttaatggtagcttagcagaagaagaggtcgtcatcagatcagttaattttacagacaacgcaaaaacaatcatcgtccagctcaacacttcagtagagattaattgtactagacctaacaacaacaccagaaaacgaatccgaatccaaagagggccaggacgcgcctttgttacgatcggtaaaatcggaaatatgagacaagctcattgcaatattagtagagcaaaatggaacaatacccttaaacaaatcgcttctaagttaagagaacagtttggtaacaataaaaccattatttttaaacaatcatcaggcggggatccagaaatcgtaactcattcatttaattgcggaggagaatttttttattgtaactcaacacaactattcaatagcacttggtttaattctacttggtcaacagaaggttcaaataatacagaaggatcagatacaattacattaccatgtcgtattaagcaaattattaacatgtggcaaaaagttggaaaagctatgtatgctcctcctatttcaggacaaattcgatgctcttcaaatatcacaggacttttattaactagagatggagggaattcaaataacgaaagcgagattttcagaccaggcggaggagatatgagagataactggcgcagtgaattatataaatacaaagttgttaaaatcgaaccattaggagtagccccaaccaaagcaaaacgtcgcgttgtccaatcagaaaagtcagccgtattagaacaattagaatcaatcattaattttgaaaaactcacagaatggaccagctttctagaacatcatcatcatcaccattaa

SEQ ID NO: 52 - protein, 571 aa, Artificial Sequence
  Fusion construct between peptide from Streptococcus mitis pulA gene and peptide from Human immunodeficiency virus gp120 gene
MVYSIRSLKNGTGSVLIGASLILLAMATPTISANENTPTTNEPSNRNTTSLTQPLTDATNIAGKNESDFSSPDSANASATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYSLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQSEKSAVLEQLESIINFEKLTEWTSFLEHHHHHH

SEQ ID NO: 53 - DNA, 1212 bp, Artificial Sequence
  Fusion construct between Streptococcus mitis pulA gene and Mycobacterium tuberculosis 85b antigen gene
atggtctacagcatccgttccctcaaaaatggaactggttctgtccttattggagcaagccttattctgcttgccatggctacaccaactatctcagcaaacgaaaatacaccaaccactaacgaacccagcaacagaaatacgacctcccttactcaacctcttactgatgcaacaaacatcgctggcaagaacgaaagcgatttttcttcacccgatagtgcaaacgcttccatgacagacgtttctagaaaaattcgtgcttggggaagacgtttaatgattggaaccgctgctgccgttgttttacctggactcgttggattagccggtggcgccgctacagccggagctttttctcgtcctggtttgcctgttgaatatttacaagttccttctccatctatgggtcgcgatatcaaagtacaatttcagtctggtggcaataactctcctgccgtttacttactcgatggtctccgtgcacaagacgattacaatggttgggacattaatactcctgcatttgaatggtactatcagtcaggtctctcaatcgtaatgcctgtcggtggtcaaagtagtttttattctgattggtactcacctgcctgtggaaaagcaggatgtcaaacttacaaatgggaaacattcttaacttcagagcttccacaatggttatccgcaaatcgagctgttaaacctactgggtctgctgctattggtctatctatggctggttcttccgcaatgatcttagctgcttatcatccacaacaatttatttatgctggctcactatctgctcttctagatccttctcaaggtatgggaccaagtttaattggattagctatgggcgacgctggaggttacaaagctgccaatatgtggggaccttcttctgatcctgcctgggaacgaaatgatccaacacaacaaattccaaaattagtagcaaataacacacgtttatgggtttactgtggtaatggcacaccaaatgaacttggaggggctaacattcctgctgaattcttaaaaaattttgttagaagctcaaacttaaaatttcaagacgcatataacgcagctggagggcataatgctgtatttaattttcctccaaacggaacacattcatgggaatattggggcgcacaattaaatgctatgaaaggagatttacaaagttcactaggtgctggttaa

SEQ ID NO: 54 - protein, 366 aa, Artificial Sequence
  Fusion construct between peptide from Streptococcus mitis pulA gene and peptide from Mycobacterium tuberculosis 85b antigen gene
MVYSIRSLKNGTGSVLIGASLILLAMATPTISANENTPTTNEPSNRNTTSLTQPLTDATNIAGKNESDFSSPDSANASNELFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSMAGSSAMILAAYHPQQFIYAGSLSALLDPSQGMGPSLIGLAMGDAGGYKAANMWGPSSDPAWERNDPTQQIPKLVANNTRLWVYCGNGTPNELGGANIPAEFLKNFVRSSNLKFQDAYNAAGGHNAVFNFPPNGTHSWEYWGAQLNAMKGDLQSSLGAG

SEQ ID NO: 55 - DNA, 113379 bp, Streptococcus mitis NCTC 12261 contig1
ttttatctcacaaggttatccactatttttttcaaaaaaaagcttcataaatcaatagtttctgattttatccccaacctgtggataaaacttgataacattgtggattatttttcacagcttgtggaaaattcttgctatctatggtaaaataaatctagcattaaacttttaaatagtaaaggaggagaaaggattgaaagaaaaacaattttggaatcgtatattagaatttgcacaagaaagactaactcgttccatgtatgatttctatgctattcaagctgaactcattaaggtagaagaaaatgttgccactatatttttaccacgatctgaaatggaaatggtctggaaaaaacaactaaaagatatcattgtagtagctggttttgagatttatgatgctgaaataactccccactatatttttaccaagcctcaagatacgattatcccacaagttgaagaagctccaaattcaactctctatgactatagtccaaagttagcatctattccttattcggatactggattaaaagaaaagtatacctttgataattttatccaaggggatggaaatgtttgggcagtatcagccgccctggctgtctctgaagatttggccttgacctataatcctctttttatctatggaggacctgggcttggtaagactcacttactcaatgccattgggaatgagattttgaaaaatattcctgatgcgcgtgtgaagtacattcctgctgaaagctttataaacgactttcttgaacatctgagactgggtgaaatggataagttcaaaaaaacctaccgtagcctcgatctcttgttaattgatgatattcaatcgctgagtggaaaaaaagttgcaactcaggaagaatttttcaatactttcaatgttctccataacaatcaaaaacaaattgttctgactagtgatcgtagccctaaacacttagagggccttgaagaaagacttgtcacgcgctttagctggggcttgacgcaaaatatcacaccacctgactttgagacacgtattgccattttacaaagcaaaacagagaatttagactaccatttccaaagtgataccctagaatacctagctggtcaatttgattcaaacgtccgagaacttgaaggagcaataaacgacatcactttaatcgcccgagtgaagaagattaaggatatcactatcgatatcgctgcagaggctattagggcacgcaaacaagatgttagccaaatgctcgtcatcccaattgataaaatccaaaatgaagttggtaacttttatggtgtcagcgtcaaagaaatgaagggaagcagacgccttcaaaatattgtgttagcccgtcaagtagccatgtatttatctagagaactaacagataatagtcttccaaaaattgggaaggaatttggtggtaaagatcacacaacagtcattcatgcccatgccaaaattaaatctttgattgatgaagacgataatttacgtttagaaattgaatcaatcaaaaagaaaatcaaataacttgtggataacttttactttattatcttttttatccacattttttaaacaagcccaaaaacttgatatgacttgtttaaagtctgttttccacagatttcacagactctattattactattatccttctaatactaaaaataaataaaggagaatccatgattcatttttcaattaataaaaatttatttctacaagccttaaatactactaagagagctattagctctaaaaatgccattcctattttatcaaccgtcaaaattgacgtaaccaatgaaggtgttactttaattggttcaaatggtcaaatttcaattgaaaattttatttctcaaaaaaatgaagatgctggtttgttaattacttctttaggttcgatccttcttgaagcttctttcttcatcaatgtggtatctagtctacctgatgtgactcttgattttaaagaaattgaacaaaaccaaattgttttaactagtggcaaatcagaaattaccctaaaaggaaaagatagcgagcaatatccacgaatccaagaaatttcagcaagcactcctttggttcttgaaacaaaattacttaagaaaattatcaatgaaacagcttttgctgcaagtacacaagaaagtcgtccaattttaacaggtgttcattttgtattgagccaacacaaagagttaaaaacagttgcaacagactctcatcgtctaagccagaaaaaattgactcttgaaaaaaatagtgatgattttgatgtcgtgattcctagccgttctctacgcgaattttcagcagtatttacagatgatattgaaactgtagagattttctttgccaacaatcaaatcctctttagaagcgaaaatattagcttctatactcgtttgttagaaggtaactatcctgatacagatcgcttgattccgacagactttaacactactattacttttgatgtggtaaacttacgtcagtcaatggagcgtgctcgccttttatcaagtgcgactcaaaatggtactgtgaagcttgaaattaaaggtggtattgttagcgcccatgttcattctccagaagttggtaaagtaaacgaagaaatcgatactgatcaggtgactggtgaagatttgactattagtttcaacccaacttacttgattgattctcttaaggctttaaatagcgaaaaggtgaccattagctttatctcagctgttcgtccatttactcttgtgccagcagacactgatgaagacttcatgcagctcattacaccagttcgtacaaattaagtgaaagaggttgagcctggctcgcctcttttatgatataatctaaaaagagaaggagagtagtatgtatcaagttggaaattttgttgaaatgaaaaaaccacatgcttgcaccatcaagtcaacaggtaaaaaggccaatcgttgggaaattacacgtgtaggagcagatatcaaaattaaatgtagcaattgtgaccatgttgtcatgatggggcgctatgattttgatcgaaaaatgaataaaattattgactgaaacccctcagttagagggttagcaagttttccctttttgtgttataatattagggattgaaatgaaaacggagaatgagaaaatatggctttaacagcaggtatcgttggtttgccaaacgttggtaaatcaacactatttaatgcaattacaaaagcaggagcagaggctgcaaactatccatttgcgacgattgatccaaacgttggaatggttgaggttccagatgaacgcctacaaaaattgactgaaatgatcactcctaaaaagacagttccaacaacatttgaatttacagatatcgcaggaattgtaaaaggagcttcaaaaggagaagggctagggaataaattcttggctaatatccgtgaagtagacgcgattgttcacgtagttcgtgcttttgatgatgaaaatgtgatgcgcgagcaaggacgtgaagatgcttttgtggatccacttgcagatattgatactattaacctggagttgattcttgctgacttagaatcagttaataagcgttatgcgcgtgtagaaaagatggcacgtacgcaaaaagataaagaatcagtagctgagtttaatgttcttcaaaagattaaaccagtcctagaagatggaaaatcagctcgaactattgaatttacagatgaagaacaaaaagttgtcaaaggtctcttccttttgacgactaaaccagtgctctatgttgccaatgtggatgaggatgttgtttcagaacctgactctatcgactatgttaaacaaattcgtgaattcgcagcgacagaaaatgctgaagtagtcgttatttctgcgcgtgctgaggaagaaatttctgagttagacgaagaagataagcaagagtttcttgaagcacttggtttgacagagtcaggcgttgacaagttgactcgtgcagcttaccacttacttggattgggaacttacttcacagctggtgaaaaagaagttcgcgcttggacctttaaacgtggtatgaaggctcctcaagcagctggtattatccactcagactttgaaaaaggatttattcgtgcagtaactatgtcatatgaggatctagtgaaatacggatctgaaaaggctgtaaaagaagctgggcgcttgcgtgaagaaggaaaagaatatatcgttcaagatggcgatatcatggaattccgctttaatgtctaataatatttaacaaatagtgtcaattaggttggaaaaaaattccaacccttttggcttttgaaaggaaaaataaatgaccaaattacttgtaggattaggaaatccaggagataaatattttgagaccaaacacaatgttggatttatgttgattgaccaactagcgaagaaacagaatgtcacttttacacacgataagatatttcaagctgacctagcatcctttttcctaaatggagaaaaaatttatcttgtcaaaccaacgacatttatgaatgaaagtggaaaagcggttcatgctttattgacttattatggtttggatattgaagatttactcatcatttacgatgaccttgacatggaagttgggaaaattcgtttaagagcaaaaggttcagcaggtggtcataatggtatcaagtctattattcaacatattggaacccaaacctttaatcgtgttaaaattggaatcggaagacctaaaaatggcatgtcagttgttcaccatgttttgagtacttttgacaaggatgattatattggtattttacagtctattgacaaagttgacgattctgtaaactactatttacaagagaaaaactttgaaaaaacgatgcagaggtataacggataaatggtgaccttattagatttattctcagaaaatgatcagataaaaaaatggcatcaaaatctgacagataagaaaagacaattaatcttaggcttgtcaacttctacaaaaactttagcaattgctagtagtttgagacaggaagataagattgtgttattgacgtcaacttatggagaagccgaaggacttgttagtgatcttatatctatcttgggtgaggaacttgtctatccatttttggtagatgactcccctatggtcgagtttttgatgtcttcacaagaaaaaatcatttcactggttgaagccttgcgttttttgactgattcatctaagaaagggattttagtttgtaatatcgcagcaagtcgattgattttaccgtctcccaatgcatttaaagatagtattgtaaaaataacagttggtgaagaatatgaccaacacgcacttatccatcagttaaaagagataggctatcgaaaagttacacaagtacaaactcaaggcgaatttagtctgcgaggagatattttagatatttttgaaatatcccagttggaaccttaccgaattgagttttttggtgatgaagtcgatggtattaggtcatttgaagtcgaaacacaattatcgaaagaaaatcagacagaactcattatctttccagctagtgatatgcttttgagggaaaaggattatcaacgaggacaatcagctttagaaaaacaaatttcaaaaacgttatcacctattttaaaatcatacttagaagaaattctttcaagttttcatcaaaaacaaatgcatttagattctaggaagtttttatctttgtgttatgagaaatcatggactgtatttgattatattgaaaaagatacaccaatattctttgatgattaccagaaattgatgaatcagtatgaagcatttgaaagagaattagcgcaatactttacagaagatttacagaatggtaaatcattttctgagatgcagtattttgcagatacagagcaaaactataaaaaacaaagtccagttacctttttctccaatctgcaaaagggcttaggaaatctcaagtttgatcacatttatcaatttaatcaataccccatgcaagagtttttcaatcagttttcttttctaaaagaagaaattgaacgatacaaaaaaatggactacactattattctgcaatctagcaattcaatgggaagtaaaacattggaggatgttttagaggaataccagattaaattggactctagagataagtcaagtatctgtaaagaatctgtaaacttaatcgagggcaatctcagacatggttttcattttgtagatgaaaaaattctggtgattactgaacatgagatttttcaaaagaaattaaaacgtcgttttcgaagacaacatgtttcaaatgcagagagattaaaagattataatgaacttgagaaaggggactacgttgttcaccatatccatggaattggtcaatatctagggattgaaacaattgaaatcaaagggatacaccgcgattatgtcagtgtccaataccaaaatggtgatcaaatctctatcccagtagaacagattcatctactttccaaatacgtttcaagtgacgggaaagctcctaaactcaataagttaaatgatggtcattttaaaaaggctaagcaaaaagttaagaatcaggtagaggatatagctgacgatttaatcaaactctattctgagcgtagtcagttgaagggctttgctttctcagctgatgatgaagagcaagatgcttttgatgatgcttttccttatgttgaaacggatgatcaacttcgtagtatcgaggaaatcaagagagatatgcaagattctcagccaatggataggctattggttggggatgttggttttggaaagactgaagttgcaatgcgtgcagcctttaaggcagtcaatgataacaaacaggtggtcgttctagttccgacgacggttttagcgcaacagcactatacgaattttaaggaacgattccaaaattttgcagttaatattgatgtgttgagtcgctttagaagtaaaaaagagcagactgaaacacttgaaaaattgaaaaacggtcaagttgatattttgattggaacccatcgtgttttgtcaaaagatgttgtgtttgctgatttgggcttgatgattattgatgaggaacaacgatttggtgtcaagcataaggaaaccttgaaagaactgaaaaaacaagtagatgtcctgaccttgacagcaacgccaattcctcgtacccttcacatgtctatgctgggaatccgagatttgtctgttattgaaactcctccaactaatcgctatcctgttcaaacctatgtattggagaagaatgatagtgtcattcgtgattctgtcttgcgtgaaatggagcgtggaggtcaagtttactatctttacaataaagttgacacaattgatcagaaggtttcaaaattacaggagttgattccagaggcttcaattgggtatgttcatgggcaaatgagtgagattcagttagaaaatactctactagatttcattgaaggtcagtatgatatcttggtgacaactaccattattgagacaggggtggacattccaaatgccaatactttatttattgaaaatgcggaccatatgggcttgtcaaccttgtatcagttaagaggaagagttggtcgtagtaatcgtattgcttatgcttatctcatgtatcgtccggaaaaatcaatcagtgaagtatctgaaaagagattagaagcaatcaaaggatttacagaattgggctccggatttaagattgcaatgcgagatctttcgattcgcggagcaggaaatcttttagggaaatcccagtctggtttcattgattctgttggttttgaattgtattcgcaattattggaggaagctattgctaaacgacatggtaatgggaacacaagaaccaaagggaatgctgagttgattttacaaattgatgcctatcttcctgatacctatatttctgatcaacgacataagattgaaatttacaagaaaattcgtcaaattgacaaccgtgccaactatgaagagttacaagaagagttgatggaccgctttggagagtacccagacgtggtagcctatcttttagagattggtttggttaagtcttatcttgacaaggtctttgttcaacgtgtggaaagaaaagataataagattacagtacaatttgaaaaagtcactcagcgattgtttttggctcaagattattttaaatctttatctgcaacgaatttaaaagcagccataactgagaataagggattaatggaagttgtatttgacatccgaaacaagaaggactatgaaattttagaaggtctgctcatttttggagaaagtttattagagataaaagaatcaaaggaagcaatttccctttaacatttttcttctataaaagggataaaaatggtacaataataatttgaggtaataaaaatgagattagacaaatatttaaaagtatcaagaattatcaagcgtcgtacagtcgcaaaagaagtagcagataaaggtagaatcaaggtaaatggaatcttggcaaaaagttcaacggatttgaaagttaatgaccaagttgaaattcgatttggaaataagttgctacttgtaaaagtactggagatgaaagatagtacaaaaaaagaagatgcagcaggcatgtatgaaattatcagtgaaacacgggtagaagaaaatgtctaaaaatatcgtacaattgaataattcttttattcaaaatgaacaccaacgtcgtcgctatctgatgaaagaacgacaaaaacgtaatcgtttcatgggttgggttcttattttgatgattttattgttcattttaccaacttataatcttgctcaaagttatcaccaattactccaaagacgtcaacagttatcagacttgcaaactcagtatcaaaccttaagtgaggaaaaggagaaagagacagcttttgctacaaagttgaaagatgaagattacgctgctaaatacatgcgtgcaaaatattattattctaagaatcgggaagctgtttatacgattcctgacttgctcccaaggtgataaaatggaaaatttattagatgtaatagagcaatttttgagtctatcggatgaaaaactagaagagttggctgataaaaatcaattattgcgtttacaagaagaaaaggaaaggaagaatgcgtaagttcttaattattttgttgctaccgagttttttgactatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctggaaaattgactccccaaacaagttttcaaataaccgagtggcacttaaataaacaaggaattccggtatttaagctatcaaatcatcaatttatagctgcggacaaacgatttttatatgatcaatcagaggtaactccaacaataaaaaaagtatggttagaatctgattttaaactgtacaatagtccttatgacttaaaagaagtgaaatcatccttatcagcttattcgcaagtatcaattgataagaccatgtttgtagaaggaagagaatttctacatattgatcaggctggatgggtagctaaagaatcaacttctgaagaagataatcggatgagtaaagtccaagaaatgttatcggaaaaatatcagaaggattcattttctatttatgttaagcaactgactactggaaaagaagctggtatcaatcaagatgaaaagatgtatgcggctagtgttttgaaactcccttatctttattatacgcaaagaaaaaataaatgaaggtctttatcagttagatacgactgtaaaatacatatctgcagtcaatgattttcctggttcctataaaccagaaggaagtggtagtcttcctaaaaaagaggataataaagagtattctctaaaggatttaattacgaaagtatcaaaagaatctgataatgtagctcataatctattgggatattacatttcaaaccaatctgatgccacattcaaatccaagatgtctgctattatgggagatgattgggattccaaagaaaaattgatttcttctaagatggctgggaaggttatggaggcaatttataatcaaaatggatttgtattggagtctttgactaaaacagattttgataatgagagaattgccaaaggtgtttctgttaaagtagctcataaaattggagatgcggatgaatttaagcatgatacaggtgttgtctatgcagattctccatttattctttctattttcactaaaaattctgattatgatacgatttctaagatagccaaagatgtttatgaggttctaaaatgagggaacaagattttttaaatcattttctcaagaagggatatttcaaaaagcatgctaaggtggttctagctctttctggtggattagattctatgtttctatttaaggtgttatctacgtatcaaaaagagttagaaattgaattgattctagctcatgtgaatcataagcagagagtagaatcagattgggaagaacaggaattaaggaagttagctgctgaagcagagcttcctatttatatcagcaatttttcaggagaattttcagaagcgcgtgcacgaaattttcgttatgatttttttcaagaggtcatgaaaaagacaggtgcgacagccttagtcactgcccaccatgctgatgatcaggtggaaacgattttgatgcgcttgattcgaggaactcgtttgcgctatctatcaggaattaaggagaagcaagtagtcggagagatagaaatcattcgtcccttcttgcattttcagaaaaaagacttcctatcaatttttcattttgaagatacatcaaataaggaaaatcattattttcgcaatcgtattcgaaactcatacttaccagaattagaaaaagaaaatcctagatttagagatgcaatcttaagtatcggtaatgaaattttagattatgacttagctatagctgaattatcaaaaaatattgatgtagaaaatttatatcagctattgtcttactctgagtcgacacaaagagttttacttcaaacttatctgaatcattttccagatttgaatcttacaaaagctcagtttgaagaagttagacaaattttaaaaactaaaagccagtatcgtcatccgcttaaaaatggttatgaattagtaaaagagtatcaacagtttcggatttgtaaaatcagtcctcagtctgatgaaaaggaagatgaacttgtgttacactatcaaaatcaggtatcttatcaaggatatttattttcctttggacttcctttagatggtgaattaattcagcaggtacctgtttcacgggaaacatcagtacacattcgtcatcggaaaacaggagattttttgattcaaaatgggcatagaaaaaaactcagacgtctatttattgatttgaaaatccctatggaaaagcgaaaatcagctctgattattgagcaatttggtgaaattgtctcaattttgggaattgcgaccagtaatttgagtaaaaacacgaaaaatgatataatgaacactgtactttatatagaaaaaatagataggtaaaaaaatgttagaaaacgatattaaaaaaatcctcgtttcacacgatgaaattacagaagctgctaaaaaattaggtgctcaattaactaaagactatgcaggaaaaaatccaatcttagttgggattttaaaaggatctattccttttatggctgaattagtcaaacatatcgacacacatattgaaatggacttcatgatggtttctagctatcatggtggaacagcaagtagcggtgtcatcaatatcaagcaagatgtaactcaagacatcaaaggaagacatgttttatttgtagaagatatcattgatacaggtcaaactttgaagaatttgcgagatatgtttattgcaagagaagcagcttctgttcacattgcaaccttgttggataaaccagaaggacgtgttgtagaaattgaggctgactatacctgctttactattccaaatgagtttgtagtaggttatggtttagactacaaagaaaattatcgtaaccttccttatgttggagtattgaaagaagaagtatattcaaattagaaagaacaatttttaatgaaaaaacaaaataatggtttaattaaaaatccttttctatggttattacttatttttttcctagttacagcttaccagtatttcagtacaggtagtgttgcagggaaaagtgagcaaattaattatacagaattggtaaaagaaattaccgatgacaatgtaaaagaattaacctaccaaccaaatggcagtgttatcgagatttcgggtgtctataaaaatcctaaaacaagtaaagaagaaacaggtatccagttcttttctccttctgctacaacagtagagaaattttcaagtattattcttccttcagatactacagtatcagaattgcaaaagcttgcttctgaccataaagcggaagtaactattaagcatgaaagttcaagtggtatgtggattaatattcttgtatccattgtgccattcggtatcctcttcttcttcctcttctcgatgatgggaaatatgggaggaaataatagccgtaacccgatgagttttggacgtagtaaggctaaagctgcaaataaagaagatattaaagtaagattttcagatgtggctggagctgaggaagaaaaacaagaactagttgaagttgttgaatttctaaaagatccaaaacgatttacaaaacttggagctcgtattccagcaggtgtccttctggagggacctccgggaacaggtaaaactttgcttgctaaggcagtcgccggagaagcaggtgttccattctttagtatttcaggttctgactttgtagaaatgtttgtcggagttggagctagtcgtgttcgttctctttttgaagatgccaaaaaagcagcaccagctattatctttatcgatgaaattgatgctgttggacgtcaacgtggagttggtcttggtggaggaaatgacgaacgtgaacaaaccttgaaccaacttttgattgagatggatggttttgagggaaatgaagggattatcgttatcgctgcgacaaaccgttcagatgtacttgatcctgcccttttacgtccaggacgttttgatagaaaagtattggttggccgtcctgatgttaaaggtcgcgaagcaatcttgaaagttcatgctaagaacaagcctttagcggaaaatgttgatttgaaattagttgcccaacaaactccaggttttgttggtgctgatttagagaatgtattgaatgaagctgctttagtcgctgctcgtcgcaataaatcgataattgatgcttcagatattgatgaagcagaagatagagttattgctggaccttctaagaaagataagacagtttcacaaaaagaacgtgaattggttgcctatcatgaggcaggacataccattgttggtctagtcttgtcgaatgctcgtgttgttcataaagttactatcgtaccacgcggccgtgcaggtggttatatgattgcacttcctaaagaggatcaaatgcttctatctaaagaagatatgaaagagcaattggctggtttaatgggtggacgtgtagccgaagaaattatctttaatgtccaaactacaggagcttcaaatgactttgaacaggcgacacaaatggcgcgtgcaatggttacagagtacggtatgagtgaaaaactaggtccagttcaatatgagggcaatcatgctatgtttggtgcacagagccctcaaaaatcaatctcagaacaaacagcttatgaaattgacgaagaggttcgttcattattgaatgaagcacgaaataaagctgctgaaattattcagtcaaatcgtgaaactcacaagttgattgcagaagcattattgaaatacgaaacattggatagtacacaaattaaagctctttacgaaacaggaaagatgcctgaaaccgtagaagaggaatctcatgcattatcttatgatgaagtaaagtcaaaaatgaatgatgaaatataaccctgagagaggcgtgacctctcttttttgtgcagttgagacggtaaaggagacagaataggcgaaatggtcccaattaagttcttgatttgttagactgtatctagaaaggggaacgttatgtttaaagaattatatgaagaagtccaggggattgtatataagtgtagaaatgaatatcatctccatttatgggagctatcagattgggaccaagagggaatgatttgcttacatgaattgattagtagagaagaaggaatagtagaagatatcccacgcttacgtaaatacttcaaaactaaattccgtaatcggatcctagactatatccgtaagcaggaaagccagaagcgtagatatgataaagaaccctatgaagaagtaggtgagattagtcatcgtatcagtgagggaggtatgtggctagatgagtattatctctttcatgagacactaagagattatagaaacaaacaaagtaaagacaaacaagaagagttagaacgcgtcttaagacatgaacgcttccgagggcgtcaaagagtattgagagacttacgtattgtgtttaaggagtttgatatccgtactcattagggagtcatacaaaaaaacataaaaagtttaaaaaagtagttgacaagtcagaaaaagtctgtataatagtaagagttgaaaataacagctcaggtccgttggtcaaggggttaagacaccgccttttcacggcggtaacacgggttcgaatcccgtacggactatggtatgttgcggttgaggcacttgatgaaaaaagattaaaaaagtttcaaaaaagtgttgacaagcgaaagcgactgtgatatactaatatagttgtcacttgagagaagcaagtgacaaagacctttgaaaactgaacaagacgaaccaatgtgcagggcactataactaaggttatagtactgaacaatgaaaaaacaataaatctgtcagtgacagaaatgagtgagaactcaaacttttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaactgcgcattggtcttgtttagtcttgagaggtcttgtggggccttagctcagctgggagagcgcctgctttgcacgcaggaggtcagcggttcgatcccgctaggctccattggtgagagatcaccaagtaatgcacattgaaaattgaatatctatatcaaatagtaacaagaaaataaaccgaaaacgctgtagtattaataagagtttatgactgaaaggtcaaaaaataaggttaagttaataagggcgcacggtggatgccttggcactaggagccgaagaaggacgtgacaaacgacgatatgccttgggtagctgtaagtaagcgatgatccagggatttccgaatgggggaacccaacaggtactacctgttacccacatctgttaaggatgtgaggaggaagacgcagtgaactgaaacatctaagtagctgcaggaagagaaagcaaaagcgattgccttagtagcggcgagcgaaacggcaggagggcaaaccgaagagtttactcttcggggttgtaggactgcaatgtggactcaaagattatagaagaatgatttgggaagatcagccaaagagagtaatagcctcgtatttaaaatagtctttgtacctagcagtatcctgagtacggcgggacacgtgaaatcccgtcggaatctgggaggaccatctcccaaccctaaatactccctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgttatgatgcgaggttaagttgaagagacggagccgtagggaaaccgagtctgaatagggcggattagtatcatgacgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacattagagattcttggaggtagagcactgtttgggtgaggggtccatcccggattaccaatctcagataaactccgaatgccaatgaattatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggatacctttataggtatggtaggagagcgttctatgtgtgaagaaggtgtaccgtgaggagtgctggaacgcatagaagtgagaatgccggtatgagtagcgaaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatgtagtgatggagggacgcagtaggctaactaaagcagacgattggaagtgtctgtctaagcagtgaggtgtgatatgagtcaaatgcttatatctgtaacattgagctgtgatggggagcgaagtttagtagcgaagttagtgacgtcacactgccaagaaaagcttctagcgtttaagcatactctacccgtaccgcaaaccgacacaggtagtcgaggcgagtagcctcaggtgagcgagagaactctcgttaaggaactcggcaaaatgaccccgtaacttcgggagaaggggtgctgactttaagtcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtgtctgtaccacatgtacaggataggtaggagtctatgagatcgggacgccagtttcgaaggagacgttgttgggatactacccttgtgttatggccactctaacccagataggtgatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataaacgctgaaagcatctaagtgtgaaacccacctcaagatgagatttcccatgattttatatcagtaagagccctgagagatgatcaggtagataggttagaagtggaagtgtggcgacacatgtagcggactaatactaatagctcgaggacttatccaaagtaactgagaatatgaaagcgaacggttttcttggtttgaatagatattcaattttgagtaggtattactcagagttaagtgacgatagcctaggagatacacctgtacccatgccgaacacagaagttaagccctagaacgccggaagtagttgggggttgccccctgtgagatatggaagtcgcttagctctaatccgccatagctcagttggtagtagcgcatgactgttaatcatgatgtcgtaggttcgagtcctactggcggagtagttaagaaaaaagaggtttaggcctcttttttttataattaataatctatttagtgttatttggtgtgagatatttttgctgagtaaagtttcagagccctccgttttcgatcaaggagatctttttagtactttaattgagggtagcgaagaggctaaacgttgcggactgtaaatacgctccttcgagggattcgaatccttccgcttccattatcttagtttttgaaatttaagtagtaaatttgttcctattctgtcaacttttcctatttgttatctttttgaggttggtattttaacaattcaggaattattaaagattaattgaaattttttgttagaataaggtcataaaaagaaaaggagtatatatttatgctacaaagtatttatgatcagatgatggatttttatagaaatattgaagaagagtatggtatgttcttgggtgataattttgattgggaacatgttcattttaagtttttgatttattatcttgtccgatatcgtattgtgagtcatcgggattttattgtttaccattatcgtgttgcttatcgtttgtatcttgaaaaattgataatgaaacagggttttgttgcttgatgagacagtatgagttaatttccgaacaacttttactttttgtggaaaaataatgataaatagccggaattttttctaaaacattttttaatagttggaaatagcaaatctttctattgtttcttcttgataaaaaggcgattttttcttataataaattgtaagatataattgcaggtgagagtcctgccatgtatgtgagaaaggaagagcctgagggctcagacaagattatgacttcagttgttgttgtaggtacccaatggggtgatgaaggtaaagggaagattacagacttcctttcagcgaatgcagaagtgattgcgcgttaccaaggtggtgataatgcaggtcacacgattgtgattgatggcaagaagtttaaattgcacttgattccatctgggattttcttccctgaaaaaatctctgttattgggaatggtatggttgtaaatcctaaatctcttgtaaaagagttgagctatcttcatgaggaaggtgttacaactgataacttgcgtatttctgatcgcgcgcatgtcattttgccttatcatatcgagttagatcgtttgcaagaagaagctaagggcgacaataagattggtactacaatcaagggaatcggtccagcttatatggacaaagctgctcgtgtgggaattcgtatcgcggatcttttggataaagacattttccgtgagcgtttagaacgtaaccttgctgaaaagaatcgtctttttgaaaaattgtatgacagtaaagcaattgctttcgatgatatttttgaagaatattacgaatatggtcaacaaattaagaaatatgtgacagatacatctgttattttgaatgatgcgcttgataacggtaaacgtgtgctttttgaaggtgcacaaggtgttatgctagatatagaccaaggtacgtatccatttgttacgtcatcaaaccctgtggctggtggtgttacgattggttctggtgttggtccaagtaagattgacaaggttgtaggtttatgtaaagcctatacgagtcgagtaggagacggtcctttcccaactgaattgtttgatgaagtgggagaacgtatccgtgaagttggtcatgaatatggtacaacaactggtcgtccacgtcgtgtgggttggtttgactcagttgtgatgcgtcatagtcgtcgtgtttctggtattactaatctttcattgaactctatcgatgttttgagtggtttagatacagtgaaaatctgtgtggcctatgatcttgatggtcaacgtattgactactatccagctagtcttgagcaattgaaacgttgcaagcctatctatgaagagttgccaggttggtcagaagatattactggagttcgtaatttggaagatcttcctgagaatgcgcgtaactatgttcgtcgtgtgagtgaattggttggcgttcgtatttctactttctcagtaggtcctggtcgtgaacaaacaaatattttagaaagtgtttggtcctaagagatttttaagatttgtttaagataggtcgggtatactatagacagttacaagaagacctcctaacttgttgtaacaaatatcctaaacttttctttttcataataatctccctataaagtcaccgcattcggtggctttttttgtcttgggattcatgatataataataaaatcgataagtaggaaaagagaaacggatgaattatacagttgaagaaaaagaagtctttatgagggaagctttgagagaggctgagattgctcttgaacacgatgaaattccaattggttgtgtgattgtcaaggacggagaaatcattggccgtgggcataatgcccgtgaggagttgcaacgagcggttatgcatgcggagattatggctatagagaatgcgaatctgagtgaggagagctggcgcttgcttgattgcacgctttttgtgaccattgagccgtgtgtcatgtgtagtggggcgattggcctcgcccgtattccaaacgtggtctatggggctaaaaaccagaaatttggcgctgctgggagtttgtacgatatcttgacagatgagcgtctcaatcatcgtgtggaggttgaaacgggaattttggaagatgaatgcgcagctattatgcaggacttttttagaaatagacggaaaaaataattttgcttttaaaatgaataggaatgtgatataataaatagtggagcaacagttctgcgtgaagcgggtcaggggaggaatccagcagccctaagcgatttgaattgtgtgctctttttttcgtgctttttccgaataaataagatagaataatctagaataaatgataatagaaaagagaaaatgatgaaaattcgtggttttgaattggtttcgacttttacagataaaaatttattgcccaagcgtgagacagcgcatgcggctggttacgatttaaaggttgctgtgcgtacagttattgcgccaggagagattgtattggttccgacaggggttaaggcttatatgcagccgactgaggttctctacctttatgatcgttcttcaaaccctcgtaagaagggcttagttttaattaactcggttggggtcattgatggggattattatggcaatactgggaatgaagggcatatttttgctcagatgaagaatattacagatcaagaagttgttcttgaagttggggaacgtgtggtccaggctgtctttgctcctttcttaattgcagatggagatatggctgatggcgttcgaactggtggatttggatcgaccgggcactagaatgaagattatctttgtacgtcacggggagccagattatcgtgagttagaggagcgttcttatacgggatttgggatagatttggcccccttgtctgagaagggacggcagcaagcccagaaactgagcaccaatcctttactcccttcagctgaaataatcgtatcttctgcagtcacaagagctttagaaacggcttcttatgtggcttgtgttactggacttcctttgagagtggaaccattattgcatgaatggcaggtctatgaaagtggcacagataattttgaaaaagctcgtgctatatttctagaaaataatggggagttacttcctaatagtcctattcaatatgagacagctgcgaagatgaagtctcgttttctagaatgcatggctaagtatcgagattaccagaccgtgatagtggtaactcacaacatgctcatgcgtcagtttgtgccaaatgagaagattgatttttgccaagtgattgagtgtgagttagagatatagaaagaggtttatcatcgcaaagaaaaaagcgacatttgtatgtcaaaattgtgggtataattcacctaaatatctggggcgttgccccaactgtgggtcttggtcttcttttgtagaagaggttgaggttgccgaggtcaagaatgcgcgtgtgtccttgacaggtgagaaaaccaagcccatgaaactggctgaggtgacttccatcaatgtcaatcgaaccaagacggagatggaggaattcaaccgtgtacttggaggcggagtggtaccgggaagtctcgtcctcataggtggggatcctgggattgggaaatcaacccttctcctacaagtctcaactcagctgtctcaagttgggactgttctctacgtcagtggggaggagtctgcccagcagattaagctacgagcagagcgcttgggtgatattgatagtgagttttatctttatgcagagaccaatatgcagagtgttcgaactgaggtggagcgcatccagccagacttcctcatcatcgactccattcagactattatgtctcctgagatttcaggggtgcaggggtctgtttctcaagtgcgtgaggtgacagcggaacttatgcagctggccaaaacaaataacattgccatctttatcgtaggacatgtgaccaaggagggcactctagctggtcctcgtatgttggagcatatggtggatacggtgctttactttgaaggggagcgtcaccatacctttcgtattttgagagcggtcaaaaaccggtttggctccactaatgagattgggatttttgagatgcagtcgggtggcttggttgaagtcctcaatccgagtcaagttttcctagaggagcgtttggatggggcgactggttcgtcaatcgttgtgactatggaagggacgcgtccgattttggcggaggttcaggctttggtaacaccgaccatgtttggaaatgccaagcgtacgacgacaggacttgattttaatcgtgcgagtttgattatggctgttttggaaaagcgtgcaggtcttctcttgcaaaatcaggatgcctatctcaaatctgctggcggtgttaaattggatgaacctgcgatagacttagctgttgcggttgctattgcttcgagttataaagacaagccaactaatcctcaggaatgttttgtaggagaacttggtttgacgggagagattcggcgcgtgaatcgtatcgaacaacgcatcaatgaagctgctaaactgggatttactaagatttatgtacctaagaattctttgacaggaatcactccgcctaaggaaattcaggtcattggagtaacaacgattcaggaagttttgaaaaaggtctttgcataatccgtgacaaatccttttaaaaatgataagataggagaaatatttgactatcaaattttcgaggagggaatcgtgtcgtattttgaacagtttatgcaagccaatcaggcttatgttgccctacatgggcagttaaatctgccacttaaacccaaaactagagtagccattgtgacctgtatggactctcgtttgcacgttgcgcaagctctaggtttggcacttggggatgctcatatcttgcggaatgcaggtggtcgagtgacagaagacatgattcgttctctggtgatttcccagcaacaaatggggacaagagagattgtggtattgcaccatacagactgtggtgctcagacctttgaaaatggctcttttcaggagtatttgaaggaagaattgggtgtcgatgtgtcagaccaggacttcttgccctttcaagatatagaggagagtgtacgtgaggacatgcaactccttatcgagtctcccctaataccagatgatgtcattatctctggtgctatttacgatgtggatacaggaagtatgacagtcgtagaattataaatacttcatttagaaagaaagtgtatgaagaaaaacagtattttatttatttttatcttattgctatgtattggtttgcagtatgaaactatctactatacggatggttcgatgtcaggtgcggaatatggactaatgggagtttctatctttctagctctcttttacatgattccggttctttatttccttttccgtattgggaaaaaatgggaattgccaaagaacgctttgattctgtctttattgggtgggatgttcctttcaggctggttgtctagctttgctaatacctatatccatgatttattggagtttcttttcccagatagtgcatttttaaatgcctttgaaagtgctattgtggctcctttggtagaagaaccgcttaaattattgccacttgtctttgttttggctttgattcctgtacgaaaattaaaatctttgtttttacttggaattgcttctggtttgggatttcaaatgattgaggatattggctatattcgtacggatttgccagagggctttgactttactatttcgagaattttagagcgtatcatctcaggaattgcctctcactggactttttcaggtctggctgtagtaggtgtttacttgctttacagagcttataaagggcagaaggttggcaagaaagaggggcttattttcctaggtttagccttgggaactcatttcttgtttaattctccttttgttgaattggagacagagttgcctttagcgattccagtggttacggctattactctctatggtttttatcaggcttatcgttttgttgagaagcacaatgagttgatgaactagaatattttttaaaagaatgatgcaagggtacaaatatggtgcccttcttttatttttgattgaaaaatagtgcaaaaagcgctacaatggtaaatggaaaaatcttgtgaaaagcacaagcgatacatatataccggaggaaatcatgtctttttctgatttaaagctgtttgccctttcttctaatcaagaattggcaaaacgtgtagcgcaggagattgggatagagttggggaaatcaagtgtccgccaattttcagatggagagattcaggtcaacatcgaagaatcaatccgtgggaaacacgtctttatcctacaatcaactagttcgcctgtaaatgacaatctgcttgaaattttgattatggtagatgctttgaagcgtgcgagtgcagaatctgtcaatgttgtcatgccttactatggatatgcacgtcaggatagaaaggcgagagcgcgtgagccaatcacttcaaaacttgttgcaaatatgcttgaagtagctggagtggatcgtttattgaccatcgacttgcatgctgcgcagattcaaggattctttgatattcctgtggatcatttgatgggagctcctctgattgcggattattttgagcgtcgtggtatggttggttctgactatgtggttgtcagcccagaccatggaggtgtgactcgtgcccgtaagttggcagaatttttgaaaacatctattgctattattgacaaacgtcgtagcgttgataagatgaataccagtgaagtcatgaacatcatcggtaaggtagaaggcaagacttgtatcttgattgatgatatgattgatactgctggaacgatttgtcatgcggcagatgcccttgcagaagctggtgctgttgaagtctatgcgagctgtacgcacccagttctatctggtccagctatggacaatatccaaaattcagctattaagaaattggttgttttggataccatctatctgccagaagagcgtttgatcgataagattgagcaaatttcaatcgctcatctcctaggtgatgctattgtacgtatccatgaaaaacgcccactttctccacttttcagtattgagaaaaagatttaatgaccaagcctgagatgattctcaggttttttcatctcttttccgaataaatagatagagccagagaatctagaaaacctagatttaaaactgtggtataataaaaggaggaagaggatgattctcagacatccgggcatcagtccgaccaatgatttggttgctaagaaaatctttagcaatccagaaatcacttgtcaatttattcgcgatatgttggatttaccagccaaaaaatgtaccatttttggaagggagcaaatatcatgtcttgccatccctgaccttactcggctcaggatttctataccagtatagacgtcttggcggagttggataatggtacgcaagtaattattgaaattcaagttcatcatcagaattttttcatcaatcgcctgtgggcttacctgtgcagtcaggtcaatcaaaacctagaaaaaattcgtcaacgagaaggtgatacacaccagagttacaaacacatcgcaccagtttatgctattgctattgtggacagcaactacttctcagatgacttggcttttcatagctttagtatgcgcgagaacacgacaggtgaggtcttaaccatcacaaataacggtcaagaacaccatctagtcaagatggcgttcttggaattaaaaaaatacagagaaaccagcaaagatagcattcgtaagccatggttggagtttttcggtaacaaaccctttacccaagaacccgagcgagccatcagccaggcagaccaactgctggactacaagagctggtccgaggaggacaggaaaatgtttagtcaactacgtatgcgcgaagaacaagccttgttagcacaggactatgccctggaaacagctagagcagaggggctggaacaaggtattgaacaaggtttagagcgtggtcgtgcagagggaattgaaaaggggcgagaagaaggtcttgaacaaggactggagcgtgggaaattctttgccttcttagatatggttcgccaaggtcttttgccttctgaagttgctagcgagcaattaggcatgactgtctctgagtttgaggcactattgaaagattaagaccatcacaaataacggtcatgaaaaccatctagtcaagatagcattcttggaattaaaaaatacagagaaaccagcaaagacgaggttcgcaagccctggttggagttttttgggaacaaaccctttacccaacaaccagagcgagccatcagccaagcagaccaactgctagactataagagctggtccgaggaggacaggaaaatgtttagtcaactacgtatgcgagaagaacaagccttgttagcacaggactatgctttggaaacagctagggcggaaggtattgaacaaggtttagaacgtgggaaagttgaaggaagagtctttgctttcttagatatggttcgccaaggtctcctgacttccgaggttgccggccagcagttgggcatgacggtcgctgagtttgaggccttgctataaggtcacattttaaatagtagaaagttgatgaaatggcaagttcttatcaaaaaacttgccatttttacttgacatttagaagtgtttataagataataccatagacgtgagttctgtccaactgtctatgtggattagatatgaatgattatactcaagggtcaaaagtttgtgagattttcacttgaatctaggatgttttaagcgtattcactctcaaaaagttgtttttttcacctttttttctaaaaatgggtaaaaactttaaaaactagaagaaaacccttgacaaatcctgcaaatatttatatactgtatggtagtaagatagtcttacgaaaaaatatataatgaaaaatgaaggagataaaacgatgaaaaaagttttattgacaagcgcagtcgctcttgcagcatttggtgctgtacaagcagtttcagctgattcacaagcacaatacagtaatggtgtagtaccagaggctaaccaatataaaccagcaactccagttacaaacccatacgctgtaagaaatcgtatcggtaaagatggtaaagttttaccagatgtatttggaaatggtactcatgttcgtgtacatgttaaagatatccaagggaaccctgtagcaggtgctaaagtagctgctttggtatacgcaacagtagaagactttgacaactacaaaaaaccagctttgattgaagcagttactgatgcagcaggtgatgttgagtttcctcttgcaaacggtggttatgtagtttaccgtattgatgaagctccaaaaggttactttgttcctgctaaacttacagtaggtactctacttgatgcagaagaagttgtacgtgaaggttcagacatgttcgttactggtgaattagtaattgaaaaaactgatacttacaatgtagctaaagaagaatgggtacaagaagaaactggttggaaatactatgcatctaacaaagctgtaactggttggaaacaagttgacggtaaatggttcttctttaacgctgaaggcgtaatgcaaaaatggtgggttaaagatggaaacacttggtactacctaaacggaaacggtgaaatgcaaactggttggttgcaagacggtggtaaatggtactaccttgaaacatcaggtgctatgaaagctagccaatggtttgaagttggtggtaaatggtactacgttgacggttcaggtgcccttgcagttaacactactgtgggtggatacactgttaacggaaacggtgaatgggttaaataatctagctcaataaaaaagcaggagatttcttctgctttttattttttccataaaaagttcagtttttcttagaaatttttgtaaaaataagatacaataaagagaagcataatagctaaatttaagaatggagaatcttcacatgaaaaataaaaaagctttagctctagctcttgctagtgttacaatggcaagtgcagcagttttgacaagttattctgctacaactgctagttcagtaagtgcggaagaagttgtttatagaactgagtggatcacagtgattaatggtcgttcacaagaacgtaaaacagtattttttgaagatgggaatcagccgatctctaaacattcgacaattgaaggctttgaatttcaacgtgcctatgttgaaggtggaagaaaatactatttgtttgttgaaaaaggaacaaaaatagaagattatgcaaatgatccagatgctccagtgagtgagttaaatactcagggatataaaacatctgacaaggacgtaaaatggcgtgagtcagcagggaaccgttatctttactataaaggtaacccagtaaaaggttgggcaagtgtcgatggtaagacttactactttgatagtgaaggtgttatggcacgtggtgtcattgaaaacacatctgaacgttactatctagacggacaaggtgttaagaaaactggtttcattaaagtaggagaaaaaacctattattttgtatcagatggagctcgtaagacagagattatctctgaaaatggaaaaacttattttgtcaaagatggtgttgtgacaactggagctcataaggtaggtgctaaatggtatttctttgctgaagatggtacaaccaagtcaggtattgtaaaagacagtgctggtaaatggtattacatcacagcagaaggtgaacgtaagactggtcttatcaaggatgctggagataagtattactatgttactgaggaaggtgagcgtaagttcggtgaaatcactgttgatggtaaaacgtactttttgacagatgattctgatactaaagctggctggaacaaagttgacaatcattgggtttatgttaataaagaaggtaaacgtcaaactggttggcttaaagacggtggtaaatggtactactttaatgctgaaggcgtgatgcaaaaatggtggatcaaagatggtaacaaatggtactatctaaatggttcaggtgaaatgcaaactggctggttgcaagatggtggaacttggtactacctaaacagctcaggtgctatggaaactggctggttgcaagatggtggtgcttggtactaccttaaaggctcaggtgccatggtaactggttggttccaagtaggtggtaaatggtactatgcttatagttcaggtgcccttgcagtaagcactacagttgatggctattatgtaaatgccaacggtgaatgggtataaaaagactaagagagtagttttagaactgctctctttttttacatttaaatatttctacactttttatgttttttattgcatttattataggaaaaagatataatctagataaatttaaccatttaataaaggagggttttcccatgagaaaaacagtaacaggtatcttgctagccacttctgtgctagctatggcgacagttcaacaagtacaggcagctgatgcagggggagcaacgactacaacaacttctacggttaaagaagtccgctatgcaacatataaaaatggtggacctgtcaatgtcaaagatgcactaacagggtctgctgtgacagctgaatctattcagaatcatcctgaaattgaaaattatatctatacttctagtagagaagagaatggtattatgtatcatatgtatgctccaaaagctactgattctaatacaaatgctggtactcaaaccaatccgtaccgtcaaaacaatggcactagtaatgctaatgggaacaataaccaaaatggtactggttcaaacaataatagtggctcaacaacaaattctaattctccagtaaaaacagttcgttttgtcgaatataaagctggtagtgatgttccaattgatattaaagatccacgtacaggatctgaagcatcagacacaagccatccaacaattgctaactatgagtatgttactggtaatttaaaagatggtattctttatcatgtctatcgttcaaacacagctactaatgctggtaacaacaaccaaaatcaatctacaacgacaagtggcggtcagttcaaaacagagaacggaaaagtctactatatcaaggacggtaaaaaggttagcggttggcaaaaaatcgatgataagacttactactttgaagctgatggtgctatgaagaaaggtctattgactgcaggtgataagcaatactatctagatgaaaaagatggtgttaaaaagctaggctttgtaaaagttgctgacaagacttattattttgtagaagatggtgagaagaaaactggttttgttaaaattgatgagaaaacttactatgtcaaagaaggtgtccgtctaactggtgatattactgttgatgggaaacattattttttggatgaggaaggtgtccttaaacaagggattgttatgattgatggtaaaaaattcttcatcgatagcgaaggaaatcgtcaggctggctggaagaaggtcgagattgactggtactatttctctaaagaagatggaatgaagactggttggctgaaagatggtggtaagtggtatcattttagtgccgcaggcgtgatgcaaaaatggtggtttaaagaaggtgacacttggtactacttaaatggttcaggcgaaatgcaaactggttggttgcaagatggtggcacatggtattatctaaatggttcaggtgccatggcgacaggctgggctcaagttggtggtacttggtactacttaaacagttcaggtgctatgaaaactggttggttgaaacaaggtggtagttggtattatcttgatggttcaggcgctatgaagactggctggttccaagtagatggcaaatggtactatgcttatagttcaggcgcccttgcagtaagcactacagttgatggttattacgtaaatgctaacggtgagtgggtttaaaagtgtaaaattcaccatagaaaatgtaaataataaaaagaaaacaaaaggaaagcttataaaataggctttctttttttgttatgagagctgtatttgaaaattaatataagtatataattgtataaataaaataatctattacttgattatatttttagaaagcgttataataaatccaaatatgattctaaaaaaggggtttcaaatatgaataaaaagaaaatgattttgactagtttggctagtgttgctgttttgggagcggcatttgttgcatctcaaccatcagttgtaaaagctgatgattctacaacaagtcaacctacagctactaaacctgctggagaaactggagctgctgacacttctaaatcagaagttacaagtccagaaattaaaaaagctgaagatgacgctaaagctgctgaagctaaagttactgaagctcaagcaaaagtagatacaacaactactgcagctaacgaagcaaatactaaactagaagctgagaaaaaagaagctgctgatgctaaaactgcaaaaactgaagctgaagaagctaaaaaagctgctgatgctgaattagctgctgctaaagaaaaagctgctgaagccgacgccaaagctaaagaagaagctaaaaaagaagccgacgctaaaaaagaagaagcagattctaaagaagctttaactgaagctttgaaacaacttcctgataacgaattgcttgacaaaaaagcaaaagaagatttattaaaggctgtagaagctggtgacttaaaagcttctgatattcttactgaattagcagatgatgataaaaaagctgaagctaataaagaaactgagaaaaaattaagagataaagaccaagcttctactgctaatgctgatgcaactccagctaaagaagctaaaactaaagatcaattaccagcagacattaaggctggaattgacaaagctgaaaaagcagatgctgctcgtcctgcatcagaaaaacttcaagataaagctgatgatttaggtgaaaatgttgatgagcttaaagaagatgctgaagcattgaaagctgaagaagataaaaaagctgaagctcttaaaaaacaagaagatacattaaaagaagctaaagaagctcttaaatatgctcaagacaacggttctgatgctgatatcgttgcttcattagataaagctgtaaaagctatcgaaaaagctaaagaagttgctcaagatgcattcgataaagctgcttctgatactcaagctgttgctgatgaattaaataaacttactgatgagtataacaaagctcttgatgaagtaaaagctgctaaagaaaaagaagctaacgaaccagctaaaccagtagaagaagaaccagctaaaccagcagaaaaaacagaagcagaaaaagctgctgaagctaaaaaagaagctgacgctaaggttgctgaattagagaaaaaagttgctgaagaagctaaaaaagtagaagaagctacagctaaagctactaaagaagctgaagatgtaaaagctgctgaagaagctaaaaccacagctgataaagcaaaaactgacgcagaagctgaattagctaaagctactaaagaagctgaaaaagctaaagctaaagttgaagagcttaaaaaagaagaaaaagacaacttagaagctcttaaagctgctttagatcaacttgaaaaagaaattgatgctgatgctaaaattacaaataaagacgaagctaaagctgcaatcggtaaagatgctttattaaaagctatcgaagatggtgttatcactgctacacaagctgctaaagaattagaagatcaaaatgcgactgctaaagctaacaaagatgtcgaaaataaattaagaaataaagatcaagtaaacgatgcaactcctgctacaacggctccaactatcaaacatggagataaacagcctgctgaagattctggagaaaaaatttctgatacagataaaaaagcatttgatgaagctgataaaaaagaagcttctaaaccaattgttaaaaaacttcaagatatcgctgatgatatagctgaaaaaatcgaaaaattaactaaagtagctgataaagacaaagctgatgctactgaaaaagctaaagcagtagaagaaaaaactgctgcattaaataaacaaaaagaaactttagataaagctaaagctgcacttgaaacagctaagaaaaataatgctgagcaagctatccaagatggattacaagatgctgttactaaattagaagctgctgttgcttctgctaaaactgctgctgatgaagctcaagctaaattcgacgaagttaacgaagcagtaaaagcttataaagatgcaatcgatgaactaactgacgattacaacgcaactttaggttatatcgaaaacttaaaagaagttcctaaaggtgaagaacctaaagacttcgcaggtggagtaaatgatgatgaagcaccaactggcgacgctaaacaacctgatgaggttccaactgttccaaatgctcctgaattcaatggtggggtaaaccctgctgaagctgctactgctgaagaaaaacctgagttcaatggcggagtaaacgctgctgaagctgctactactgaagaaaaacctgagttcaacggtggtgtaaacgatgaagaagcgcctacaactgaaaatactcctgagttcaatggtggtgtaaatgatgataacgctactactcaacctaataatccagaatttaacggcggagtgaatgatacaacacctccaactgagccagctaaaccagaaggtgaagcaccagctgagcaaccaaaaacagaagttccagatattaaatctgaaatcaaacgtcttgaaaaagaagttgaaaaacttgaatctgacgtgaaagatgcagaaaatggtgctgaagattattttgtagaaggattgaaaggtgaattagataaagctaaagcagaattagaagaacttaaagctgcttggttaaatcttgtgaatgataaacctgaatttgatttatcaaaattaaatgaaggtaaattacctgaatcgaataaagaaaatacagcgccatcaagacctgaaaaaccagctcctgaatttccaatcccagctaaagttggaacacctggaaatccaccgcgtgaaaattctgatactacagctgtcaatgaacctgcacttgtaccaaaaacaccatcagctcctggaacagatgcttcagctacaccaacagctgatacaccatcaactcctgcggttgtaccaactgtagcaggtactaacaaagacaatacttatcaagccccagctgcaaaagctgaagataagaaagaacttccaaatactggtggtaaagataatgttgcaattgcatcattaggattccttggattgctccttggtgcccttccatttgtgaaacgcaaaaactaattagttgaagatataaaagagaaggatttatgaccttctctttttgtgatatggactatagtgagagttctgttgaaaagaagaaaaaagtgaacaaaacgatgtttcagatttgttcacttttatgttattctataaacttacaatagtgcctcaaattcagcgactgtcatgcccaactgctgactggcaacctcggaagtcaggagaccttggcgaaccatgtctaagaaggcaaaaagtttcccttcttcccttccttcaactttcccacgctctaagcctttttcttcagcttgttccaaggcatagtcctgtgctaacaaggcttgttcttcgcgtctgcgttgttcactaaacattttcctgtcctcctcggaccagctcttgtagtccagcagttggtatgcctgactgatggctcgctcgggttgttgggtaaagggcttattcccgaaaaactccaaccacggctttcgaatcttgtctttgctggtttctctgtatttttttagttccaagaatgccatcttgactagatggttttcctgactgttgtttgtaattgttaaagcctcacctgtcgtgtcctcgcgcatactaaagctatggaaagccaagtcatcttggaaataattgctattcacgattgcaatggcataaacgggggcgatgtgtttgtaactttgatgtgtatcaccttctcgttgacgaattttttcgagattttgattgacctgactgcataagtaagcccacaaacgattaatgaaaaaattctgatgatgcacttggatttcgataataacctgcgtgccattgtccaactctgccaagacgtttatactggtatagaaatcctgggccgagtacggcagggaaggcaagacgtgaatgttacttccctccaaaatcgtcacattttttgcaggtaagtccagcatatcgcggataaattgccaagtgatttctgggttgctaaagattttcttagcaaccgagtcattggttgggctgatgcctggatgacgtaatgtcatattctttctcttttcattatagcacattttcaaatctaggtttactggattctctgactctatctatttattcggaaaaaggatgaaaaatactcggtctggctcttcccaatggtattttttggtgctttcctttataatgggtgtatggataagaaaaaattattattgattgatgggtcttctgttgcttttcgggcgttttttgcgctctatcagcagttggatcgttttaagaatgcggctggcttgcataccaatgcgatttatggctttcagttgatgttaagccatttgttggagcgggttgagccgagtcatattttggtggcttttgatgcgggaaagacgaccttccgtacagagatgtatgcggactataagggtggtcgggctaagactccggatgagtttcgtgagcaatttccctttattcgtgagttgctggatcatatggggattcgtcattatgagttggctcagtatgaggcggatgacatcattgggacactggataaactagcagagcagaatggttttgatattaccattatcagtggggacaaggatttgattcagctgacggatgagcatacggtggttgaactttccaagaaaggtgtggctgagtttgaggcctttacgccagaatatctcatggaaaagatgggcattacaccgacgcagtttatcgatctcaaggcgctcatgggtgataagtcggataatatccctggggtgaccaaaatcggtgaaaaaactggtatcaaactcttgctggagcatggttcgcttgagggaatttatgaaaatattgatgggatgaaggcttctaagatgaaggaaaatctcatcaatgataaggaacaggcctttttgtcgaaaaaactggcgaccattgataccgaggcaccggttgagattggtttggaggatttggtctatagtggtccagatgtggaaaatcttgggaaattctacgatgagatgggcttcaaacagctcaagcaggctttaaatgtgtcgtcagctgatgtggctgagagtttggattttactattgttgaccaaatcagtcaagatatgctgagtgaagagtctatcttccattttgagctttttggtgagaattaccatacggatgatttggttggattttcctggtcttgtggggataagctttatgctacagacaagcttgaacttttgcaagagccgattttcaaggcctttttagaaaaaacacctctgagagtttatgactttaagaaggctaaagttctcttgaatcgttttggtgtggatttgcaggcgcctgcttttgatagccgattggctaaatacctcctttcgactgtggaggacaatgaaattgcgaccatcgctagtctttatggtcagacttatttggttgatgatgagactttctatggtaagggagtcaagaaggccattcctgaacgcgagaaattcttagaacatttggcacgtaagattgcagttttggttgagactgagcctgttttacttgaaaaactcagtgaaaatgggcaattagagcttctttatgatatggagcaacctctggcttttgtccttgctaagatggaaattgctgggattaaggtcaagaaagagaccttgcttgagatgcaggctgaaaatgagcttgtcattgaaaaactgactcaggagatttatgaactggctggtgaggagtttaatattaactcgcctaagcagttgggcgtgcttctctttgaaaaattggagctacctctagaatacactaagaaaaccaagactggatactcgacagcggtggatgtgttggagcgcctagctcctattgctccgattgttaagaaaatcctggattaccgtcagattgccaagattcaatctacttatgtgattggcttgcaggactggattttggcggatggcaagattcatactcgctatgttcaggatttgacccagactgggcgtctgtctagtgtggatccaaacttgcaaaatatccctgttcgcttggaacaaggtcgtctcattcgtaaggcttttgtgccagagcgggaggatagtgtactactcagttcggactactcacagattgaattgcgcgttttggcgcatatttctaaggatgagcacttgattaaggcctttcaagagggggcagatatccatacttcgacagccatgcgggtctttggcattgaacgtcctgaggatgtgactgcaaacgaccgtcgcaatgccaaggccgttaactttggagtagtttatgggatttcagactttggtttgtctaataatttgggcattagccgtaagggagccaaagcctacattgatacctactttgaacgcttcccaggtattaaaaattacatggatgaagtggtacgtgaggcgcgtgataagggctatgtggagaccctcttcaagcgtcgtcgtgagttgccagatatcaattctcgcaacttcaatattcgtggttttgcagagcgaacggccatcaactcacctatccagggttcggcagcagatattcttaagattgccatgattcagctggataaagccttggttgcaggtggttatcagactaagatgctgttacaagtgcacgatgaaatcgtacttgaagttcctaaatctgaattggcagagatgaaaaaattggtcaaacaaactatggaagaagccattcaactcagtgttccccttatcgcagatgagaatgaaggggcaacctggtacgaggctaaataaaaagggggctagtcctccttttttgtagtagaattatgcaagccttttcaaaatatgctatactgatgaaaaaggaggatttctatgagtcaagaatttatcaatccaagtgatggcgtgattcgtcagtatctcgcaacgagtaaaacccttgctgtggtgggcttgtctgaccgtgaggaaacaacgagcaatcgagtgaccaaggaaatgcaggctcggggttataaaatcattccagtcaatcccaaggtggcaggtggcgaaatcttgggtgaaaaggcttatgctagtctagctgagattccttttcctgtagatattgtcaatgtttaccgtcgcagcgagtttctgcctgatgtggcgcgtgattttctcaaagctgatgccaagattttttgggcacagctaggacttgaaagtctagaagcggaagaaatcttgcgtgctggtggatgtgatgatatcgtgatgaatcgttgcatcaagagagaacatacacgcttgattgaggaagcataagaaaaaggtagctgatgggctaccttttgtgttatactcaatgaaaatcaaagagcaaactaggaaactagccgcaggttgctcaaaaaactgttttgaggttgcagatagaactgacgaagtcagctcaaaacactgttttgaggttgtagataagactgacgaagtcagtcacatacctacggcaaggcgacgttgacgtggtttggagagattttcgaagagtttagaaaataccgataagggtctgcataccaagactagtgaggatgatggcaatccagcagatggctccgagaagaatggattttccactggatttgaccatagcgaccagattggttttgagaccgatagcactcatggccatgacaataaggaatttagagagttgtttgagaggggtaaagaaactactggacacacctagagaggtgagtagtgtagtgaggagagaggcaaggataaagtaaaggataaaaagtgggaagacttttttcagttgtaggctttgcttgttttcttgttggcgactttgccagtaggatagaaagagcgtgatagggataatggccaaagtacgtgtgagtttaacaatggttgcagactcgagggtattggtctggtagagactatcccaggcgctagctgtggcggttacagaggaagtatcattgactgcagttcctgcaaagagggcgaagccgtcattggatagatgaagccaggtgccgagggttggaaagatgagcgcagccaagacattgaagaaaaagataacggagatggcttgggctacttccttttccttagcatggataacgggcgctgttgccgcaatggcagagcccccacagatagaagaacctactccaatcaaggtagccagttttgtgtccagtgcaaagaagcgctggaaaagataggcaacaatcaaggctattgaaatggtggacaggatgacagggagtgaagattgcccaactgcgaagacttgcgagatattgagaccaaaaccaagcaagataacggcatactggagcaattttttagaactaaaggtcaatcccgcatccagttgtttataggatgagagaaagggatgaagaagcatgcctatgaaaatcgcaaagacaggcgcgccaatgacagggaagaatcctcctaagtaccaagatatgatggaaatgagaaggcaggccaagatgcctgctccattttttgatagaaatgacataaaaacctccaaatagaatctgttaccattatagacctgtaaacaggaaaagtaaaatagaaagtggagctaacaattatttgacaagtagtgctaatcatgtgataataatcttacaagaactgtaacgaagtcttggcaaaaaacaaagatactagagctccacctctggtattttttgtcgcgcttatctaatccaaactaagtccgttagtagagttgcaataaattcattttaaatacttcaatttgttatgctagcgttattctatcatgtatttttgcggtcggggggcttttgtagtataatagagatacgttttgacagtaggaggtatctatggacttaactaagcgctttaataaacagttagataagattcaagtttcgttgattcgtcagtttgaccaggctatttcggagattcctggggtcttgcgtttgaccttgggggaacctgattttacaacgccagatcatgttaaggaggcggccaagcgggcgattgaccagaaccaatcctactatacagggatgagtggtctgctgaccttacgtcaggcggccagtgattttgttaaggaaaagtaccaactggactatgctcctgaaaatgaaatcttggttacaattggggcgacagaggctttatctgccactttgacagctattttggaagagggagataaggtgctcttgccagctcctgcctatccaggttatgaaccgattgtcaatctagttggggcagagattgtcgagattgacacgactgaaaatggttttatcttgactcctgagatgttggaaaaggctattttggagcagggtgacaagctcaaggcggttattctcaactatccagccaacccgacaggaattacctatagtcgggagcagttggaagacttggcagctgttttacgcaagtacgaaatttttgttgtctgtgatgaggtttactcagaattgacctatacaggggaagcccatgtatctctgggaactatgttgagagatcaggcaattattatcaatggtttatcgaagtcgcatgctatgacgggttggcgtttgggtctgattttcgctcctgcagcctttacagcccagttgatcaagagtcaccagtacttggtgactgccgcaaataccatggcgcaacatgctgcggtagaagcccttacagctggtaaaaacgatgcggagcctatgaagaaggaatacatccagcgtcgagattatattatcgagaaaatgactgctcttggttttgagattatcaaaccagacggtgccttctatatctttgctaagattccagcgggctacaatcaagattcctttgcttttctgaaggattttgcccagaagaaggctgttgcctttatccctggtgcagcctttggacgttacggggaaggatatgttcgcctatcttatgcagccagcatggagacgatcaaagaagccatgaaacgacttgaggagtacatgagagaagcatgattcagtctatcacgagtcaaggcttggtgctctacaatcgcaattttcgtgaggatgacaagctagtcaagatttttacagagcaggctggcaagcgcatgtttttcgtcaaacacgctggtcagtctaagctagctcctgttattcagcccttggtgttggcacgatttctcttgcgaattaatgatgacggactcagctacatcgaggactatcatgaggtgatgacctttcctaagattaatagtgatctctttgtcatggcctatgcgacctatgtagcggctcttgcagatgcgagtttgcaggacaatcagcaggatgctcccttatttgcttttttgcaaaagactttggagttgatggaagctggcttggattatcaggttttgactaatatttttgaaattcaaatcttgactcgatttgggatcagcctcaattttaatgagtgtgccttttgtcatcgggttggtcaggcttttgatttttctttcaaatatggagcctgtctttgcccagagcattatcatgaggatgagagacgttgccatctcaatcccaacatcccttatctgcttaatcaatttcaagccattgattttgagaccttggagaccatttcgctcaagtctgaaatcaagcaagagctacgccaatttatggatcaactctatgaagagtacgttggaattcatctaaaatcaaagaaatttattgattccctatccgactggggtcaattactaaaagaggagaacaaatgaaaaaaattgcagtagatgcaatggggggcgattacgcacctcaggccatcgttgagggtgtcaatcaagccctagctgacttttcagatatcgaggttcaactctacggagatgaagctaaaatcaagcaatatctgacagcgacagagcgcgtcagcattatccatacggatgaaaagattgattcagacgatgaacctacgagagctattcggaagaagaaaaatgccagtatggtattggcagccaaggctgtcaaagaaggcgaagcagatgctgtactctcggctgggaatacaggtgctttactagcagcaggattcttcatcgtgggtcgtatcaagaacatcgaccgtcctgggcttatgtcaacattgccgactgtagatgggagaggttttgacatgctagaccttggtgctaatgcggaaaatacagcccagcacctccatcaatatgcggttctaggttctttctatgctaaaaatgttcgtggcattgcgcaaccacgtgttggcttgctcaataacggaacagagagtagcaagggcgatccgcttcgtaaggaaacttacgaattactagcagctgatgaaagtttaaactttatcggaaacgtggaatcgcgtgatttgatgaatggcgttgcagatgttgttgtggcagatggtttcacgggaaacgctgtgctcaaatccattgaagggacagccatgggaatcatgggtttgctaaagaccgctattacaggtggtggtcttcgagcgaaactaggcgccctccttctcaaggacagcctcagaggtttgaaaaaacagctcaactactcagatgttggtggagcagtcttgtttggtgtcaaggcaccggttgtcaagactcatggctccagcgataccaaggctgtgtacagtacgattcgtcagattcgtaccatgctagaaacagacgtagttgcccagactgcgcgtgaattttcaggagaataaaaaagatgacagaaaaagaaatttttgaccgtattgtgaccattatccaagagcgacagggagaagactttgtcgtgacagaatccttgagtctgaaagacgatttggatgctgactcagttgacttgatggagtttatcttgacactggaagatgaatttaatatcgaaatcagcgatgaggaaattgaccagctgcaaagtgtaggggatgtggttaaaatcattcaagcaaaataaagataagaagttccaaggcatttgctttggaatttttctttggttcaagtgaccgtttaggaacagatttagtctttctagggacagtagaaatctgaggagaaataaggaatataatgaaattagaaaaatcaatctccaaaaaggaaataagaaataaagatcaaatgaaaatatcaatgagtttctgctagaatgaaattgttaatatagtcacaattttaattgactttccttttttacaggactataatgtagatataaaaaaggatttattttatagttgtgggaaggtgatggctatgtacttttgataaactagtctctatcttttgttcttggaaattttaggagttcttatggttcaggttcatgaacctgacatctattttgacttcgtttctattggattttcttgctttggatttatctattttaggaggaaagaactatgaaaaaatctaaacttctcactcttggtttgcttgcaggtgctggtctacttttgacaatcaatcaagcacaagctgcagatacttgggttaaaaatggtgctgactggaatctttcacaagatggcagtttcgctaaaaacaaatgggtacaaaacgcaggttcttggtaccactttgacggttctggtaaaatgcagacaggctggctcaaagatgggaatacatggtattcgctcgcagacagtggcgctatgcgtactggctggtacaaggaaggtagcacctggtactcacttgcaaatagtggtgctatgcgtacaggttggtacaaagaagggtctacatggtattacctcaaagacagtggcgctatggcaacaggatgggcgactgcaaatggtcaatggtcttactttgaaaaatcaggtgctatggtagcagatagagctgttccagcaagcgatggggaaagttatgtcattggtaaggatggttatatgttaaccagacttccaagtgaagttgaacaagatccttttgatgatacagttattacagatatcgttactttgtctgatggttatgactatcaccttgttcatcataagaaagatggagttgttatcgaaaagaatgcctggtatatcaaacctattgttgaacgtttttcttatcaaaagattggcgatataaaagtaaatactttagatgcaattactgataataaaaaaccaggggaagaaattgatcctaaagctgtcataaagaatttccaaaacttaccaaataagtattactttggagcagatggacgtaaggttgcgaatctaccagaattcactactcacttccctattcaaaaagttggatctgaactttatcttagaaattcaagtccagttattagtctagaatcatctggatttacaattaatgacaataaactttatctaagagatgtcaatgatcataatggtaaacttataactggatatttcacaatgtttatggacggattatcatataaagatcaccatattttaggctatgcagatgaatctggtgaaatcgtgaagatgaaagttttgcctaatgatttccgtggtcatattgaaaaaggaatttccggtttttatggagaaactgttcgatacgacagttcaacaggaaatgtttctgttgtgaaataaactatctgacagagtaaaacgaaaaagcgaacagctttgtatactaggaagtcatgttcatttcgctatagaataggaggaaatggctatgaaaaaatctaaactacttacacttggtttgcttgcaggtgctggtctgcttttgtcaatcaatcaagcacaggctgcagatacttgggttaaaaatggcgctgactggaatctttctcaagatggcagtctcgctaaaaacaaatgggtacaaaacgcaggttcttggtaccactttgacggttctggtaaaatgcagacaggctggctcaaagacggcaatacttggtattcactagcaaatagtggcgctatgcgtactggctggtacaaggaaggtaacacatggtactcgctcgcagacagtggcgctatgcgtacaggttggtacaaagaagggtctacttggtactacctcaaaggtagtggcgctatggcaacaggatgggcaactgcaaatggtcaatggtcttactttgaaaaatcaggtgcaatggtcgcagacagagctgttccagccagtgatggggaaagttatgtcattggtaaggatggatatctgttaaccaaactcccaagtcaggttgaacaatctcaagcggatgatacaattatcacaaatattgttactttatctgacgggtatgattatcatcttatttatacaaaagatggagtcattgttgaaaaaaatgcttggtacataaaacctgaatttaagaagttttctgataaatatggagataaagtttccaatacgatgttggctttagtagataatacggaagaaggacaagaaattaatcctaaagctgtcgtgaaaaatttccaaaacttaccaaacaggtattactttggggcagatggtcgtcgcgtaacaaatttaccagaaatgaccacctattcagagattaaaaaagttggaaatgatgtctatctagaaaatccaggtgcacgactttttcttggagctaccagcttcacaatcaataataataaactatactatttagatggtgataatggcaaactaaaaacaggctatctagcattgattgatgatagaccaagctatcatcactatcatattcttgtttatgcagaccaatctggtgaaattcttaaaatgaaacgattgccaacaggaatttcagattatcttaataaagaaattgacggtttctacggtcaaactgttaaaatcgatagtaagacaggaaatgtttctgttgtgaaataaactatttcacatagtaaaacgaaaaagcgaacagctttgtatactagtaagtcatgttcatttcgctatagaataggaggaaatggctatgaaaaaatctaaactactcactcttggtctgcttgtaggtgctggtctacttttatctatcaaccaagcacaggctgcagatacttgggttaaaaatggcgctgactggaatctttctcaagatggaagcttagctaaaaataaatgggtgcaaaatgctggttcttggtaccattttgacggttctggtaaaatgcagacaggctggctcaaagatggcaatacctggtattcactagcagatagtggggctatgcgtactggatggtacaaggaaggcaatacctggtattcactagcagatagtggcgccatgcgtacaggttggtacaaagaagggtctacttggtactatcttcattttagtggttctatgatgacaggttgggtgttcatagatggtaattggtattattttgaacaatcaggtgcaatggcctctgatagagttgtaaattctagtgatgggacaggctatattctcagcaaggatggccatatgttcactttacaaaatagcccttataaacatggtgacattgttcgtttaggcgatggatatgaatatctgattaaagcaaaatttgacggaaataactttactgatgttatcgtggataaaaacacttggcatattaaacctgagttcaagaagttttccgacaaatatggggatgaggttgcaaatacaaccttagctttagtagataataaagaagaaggacaagaaattgatcctaaagctgtcattcgtaatttccaaaatctaccaggtcgatattactttggagcagatggtcgtagagtattaccacttccagagatgacaactagatcagaaatcaaaaaagttggcaatgatctttatctagaagacccaggtgtacgacttcgatttgataacttcacaatcaataacaataaactatactatttagataatggacaaagtaagctcaaaacaggttactttgtactgattgatgatggtatggctacaacccactatcacttacttgtatatgcagaccaatctggtgaggttcttaagatgaaacgcttgccatcaagattttcagattattttgacaaagaaatcgatggtttctatggtcaaaaaattaagattacacagccaaataagtatgaatattacaaggttcttgtggtaaaataaatagataagcaatcttcacaacgaatataaaattaaaacgtgcaaatcattttcaagaggctttagatttcttgtattttaaaagaaactaaagccttttgtggatgtattgtttttcagaaagtatgaaaaactagagagttgtatcggggagataaatattatttcgcttaaataaattaggagtcgttttattctatgattattttagaattcttagtttctgtgctatatattctgttggtagtcgtttcaaccatggtgcctactatttatttgggtgctcaaatttccccagaattttataaaaaacgttattggatacttatatttttaattagtttatctgctcgtcaaacatttggagaattatttcatataggagttcttctcttcttttactgtatttttttattagtattgcacaagggaaaaggggaatctctttttctttctctgtatctttttctcttctttcaaagtattcgttatttatttttgacaatttggattcgtgtattatctggtgagcattgttgtttcgtagattcgttttctactttatatatatctatatttgatttattatcaatctttctatgttgtaaaattatgaagcgttggtctttggatttggatttattcttttcagatacttttaaaacccactatcgtaagagttttttcattatcctacctctgactggatttaggatattctcttcgtttatgaccaatagaaatagttctttctacgttcgttttgacacgaccatttctctcctgattttcattctctttttctcttggctcttttatatcagacacttagagcaggtttatcgtgatgagcagaccattcagagacaggaagatgagaatcgttccttgcaagggatggtggataagctgggtcatctctatgatgaagttcgaggttttcgtcatgattttgcaggaattgtcgctagtatggagcctgctatagctaatcaagatatgactgaggtgtctaccatttatcaagatgtctttctaaagaccaatgaaaagctgagaaaggcagattacacagcctttaatcttcataatattcatgatatagctattcgcaataccttggcaaaagccatgattgtggcagataatcaggggattcattttagtttggagactgtgggggttgttgaagagctggcattgcctatgttggaggctatccgtatcctctctatcctcacgacaaatgccttggaggcagctagtgagtctgaaaatccgcagattcgggtcgctttgttggcaagtgataggagtgtccgttttatcattgaaaacactcgtaagaaagaagaactgaaccccagcattctcagtcaaaagggttattcgaccaagggaaaccacagcggactgggcttagcgaccttggaggatatggtttttcattatgatttgaacttagatacccaactaggagagacgacttttagacaagatttagaattgccatttaaggatgagaaacgaggtggagaggaatgagaattttagttttggaagatgatagagtccagcagggacggatagagcagactttactagatatcggtcgctctcgcaatttgagattggaaattgatattgccaaaaactatggggatgttgaaaagtattctcagtattttgatcattaccagctctatttattggatttagagattgatggagagcgtgaacggggctttcaggttgctcaacaggttcgggagcgggatccttttacaagcattgtctttgtgtccacgcattcggaggccttgcctctagcttttcgctatcacttgtctgccttggattttatttctaaggatcaaccagaggaagattaccgtcatcagctggagcgctgtctggactatgtactggcagtggacaagagggaaaatatgcgtctcttcacctatagttttgagggaagacggggctttactctgccctaccatgagattttagcctttgaaacctcagtggaatcccaccgtatcaaggtctattatgccaatcactctatcaagaccatttatggcagtctcaaggatatcgctgccaaggctgaaaaagattactttgtctatgccaatcgcaatactttagtcagtttacaggcaattgaagagatgactgccacagaagtgaccttgttagaaggcttgcatttccccgtatcacgaacagccagaagaacccttaaaaaacatctcaatgtctaatatctgttagacttggatgagtttatcaataagaatgtcggaaaattttctgatattcttatttttttgacttctttttcgaatagataggtaagaggaaaaaggaaaggagcctagttcatgtttatatcaatgttctacccatggttcactgagttattttttaaataaaatttaatttagttgtgtattttcggattatttttcgaataaataagtgagaagaaaaagaaaggaataaaataatgaaagaacattactatggatttgttgagctaacgtcggaagaattgaccgatattcaaggtggagaaaattggacgaagacccttgcagattggtacattggatttcgtagaggtttaggtttttaggaggataagcgatgaatgaaatgactaacgagtatactattgaagtactaaaggaaagcgacttagctttgctggtgggtggtagcaaggaaagttatcaagggggtctaattacaggtctattgttacgtagtgtatttattggaaccccattttttagaagataagatttagaaaaaatagaacaagaggagaaaaggatgacaaattttgacaaaatggaacagaactttgtagctcttacagaagaagagttgatgaatgtggatggaggaattattccgatagcagtagcagctagtattattgcaggttcagcatttgcaggtttgagtgcaggtgtagctattggaattagtcgaaacaagagataaagagagaataaatgaagctttcaaacgaatgtgcggctattattatatcagcctcaggaatagtgggtttattagtaggagtagctattggattagctagtattatttaaaaaggagtatatcatgcaaaatttgaatcaatttgaaatcgtagaccaaaatgaattagagcaagtacaaggtggagtaggtttattgattgttattggaggctcattacttgctgcaggtggagctggagtagcgggttattggctatcgcgtacgtttggttaatatatttaaaggagtaggtaggatatgaaaaaattagaagaaaaatttgaaatcatggcagaagcagatttggctagtaccgagggcggacttattattactacttctacagctatcgcttggggtgttttaggagtcgttacctatatgtacggtcgtcatctaggaagcagacgttaaatttaataatttgatacaaaggatgtaagaaaaactatgaatcgtaacttagaacggtgttatctattctgaccatgaatagatcataccagaggtggcttagaaatagcagggacattaaaaattgaattaactttaaataggatgtcgtaaaggttgctatcaatgatttatttgtcccaagcttgcctagggtgacagtaaaacatcaatttcctttcataccatatttttagtaggtaggacgtttgttctgcctattttttatccaaaaagtgcatttgggaggtagataggcgcatttgggaaggaagtccagtttttgtttggggattggggtaagatagttgttatcagatgagtttatactcttcgaaaatcaaattcaaaccacgtcaacgtcgccttgccgtatatatgtgattgacttcgtcagtcttatatacaacctcaaaacagtgttttgagcagcctgcggctagttttctagtttgctctttgattttcattgagtattaggaaaaaggagatgaatatgaaatttgggaaacgtcactatcgtccgcaagtggatcagatggactgcggtgtagcttcattagccatggtttttggttactatggtagttattattctttggcacacttacgagaattggccaagacgaccatggatgggacgacggctttgggcttggtcaaggtggcagaggagattggttttgagacgcgagcaattaaggcggatatgacgctttttgacttgccagatttgacttttccttttgttgctcatgtgcttaaggaagggaaattgctccactactatgtggtgactgggcaggacaaggatagcattcatattgccgatccagatcctggggtgaaattgaccaaactgccacgtgagcgttttgcggaagaatggacaggagtgactctttttatggcacctagtccagactacaagcctcataaggatcaaaagaatggtctgctctcttttatccctatattagtgaagcagcgtggcttgattgccaatatcgttttggcaacactcttggtaaccttgattaatattgtgggttcttattatctgcagtctatcattgatacctatgtgccagatcagatgcgttcgacgcttgggattatttctattgggctggtgattgtttatattcttcagcagatcttgtcttacgctcaggagtatctcttacttgttttggggcaacgcttatcgattgatgtgattttgtcctatatcaagcatgtttttcacctgcctatgtccttctttgcgacacgcaggacaggggagatcgtgtctcgttttacagatgctaatagtatcattgatgcgctggcttcgaccattctttcgattttcctagatgtgtcaacggttgtcattatttcccttgttttattttcacaaaataccaatctctttttcataaccttattggcacttcctatctatacagtgattatctttgcctttatgaagccgtttgaaaagatgaatcgggataccatggaagccaatgcggttctgtcttcttctatcattgaggacatcaacggtattgagactatcaagtctttgaccagtgaaagtcagcgttaccaaaagattgacaaggaatttgtggattatctgaaaaaatcctttacctatagtcgggcagagagtcagcaaaaggctctgaaaaaagttgcccatctcttactcaatgtcggcattctctggatgggagctgttctggtcatggatggcaagatgagtttggggcagttgattacctataataccttgctggtttactttacaaatcctttggaaaatatcatcaatctgcaaaccaagcttcagacagcacaggttgccaataaccgtctaaatgaagtatatctggtagcttcggagtttgaggagaagaaaacggttgaggatttgagcttgatgaagggagatatgaccttcaagcaggtttcttacaagtatggctatggtcgagacgtcttgttggatatcaatttgaccattccccaaggttctaaggtggcttttgtggggatttcagggtcaggtaagacgaccttggccaagatgatggttaatttttacgacccaagtcaaggggagattagtctgggtggtgtcaatctcaatcagattgataaaaaggccttgcgccagtatatcaactatctgcctcaacagccctatgtctttaacggaacgattttggacaatcttcttttgggagccaaggaggggacgacacaggaagatatcttacgggcggtcgaattggcagagattcgggaggacattgagcgcatgccactgaattaccagacagaattgacttcggatggggcagggatctcaggtggtcaacgtcagagaattgctctggcacgtgctctcttgacagatgcgccggtcttgatcttggatgaggcgaccagcagtttggatattctgacagagaagcgaattgtcgataatcttatggctttagataagaccttgattttcatcgctcaccgcttgaccattgctgagcggacagagaaggttgttgtcttggatcagggcaagattgttgaagaaggaaatcatgctgatttgcttgcacagggtggtttttacgcccatttggtcaatagctagaaagaggagaggatgaaaccagaatttttagaaagtgcggagttttataatcgtcgttaccataatttttccagtcgggtgattgtccccatgttccttctgctcgtgtttttacttggctttgcaactttggcagagaaggagatgagtatgtctactagagctactgtcgagcctagtcgtatccttgcaaatatccagtcaactagcaacaatcgtattcttgtcaatcatttggaagaaagtaagctggttaaaaagggagaactgttggttcaatatcaagaaggggcagagggtgtccaagcggaggcctatgctagtcagctggacatgctcaaggatcaaaaaaagcaattggagtatttgcaaaagagtctgcaagaaggggagaaccactttccagaggaggataaatttggctaccaagccacctttcgtgactacatcagccaagcaggtagtcttagggctagtacatcgcaacaaaatgagaccatcgcgtcccagaatgcagcagctagtcaaacccaagccgaaatcggcaccctcatcagtcaaacagaggctaaaattcgcgattaccagacagctaagtcagctattgaaacaggtgcttccttggccagtcagaatctagcctactctctctaccagtcctacaagtctcagggcgaggaaaatccgcaatctaaggcacaagcagttgtgcagctagaagcacagctttctcagttagaatctagtcttgctacttaccgtgtccagtatgcaggttcaggtacccagcaagcctatgcgtcaggtttaagcagtcaattggagtctctcaaatcacaacacttggctaaggttggtcaggaattgacccttctagaccagaaaattttggaggcagaatcgggtaggaaggtacagggaaatcttttagacaaggggaaaattacggcgagtgaggatggggtgcttcatcttaatcctgagaccagtgattctaccatggtagcagaaggcgccttactagcccaactctatccgtccttggaaaaagaagggaaagtcaaactcacagcttatctaagttcaaaagatgtagcaaggatcaaggtcggtgattctgttcgctatactacgactcatgatgctaagaatcaacttttcctagattctactattacaagtattgatgcgacagctactaagactgaaactgggaatttctttaaaatcgaggcggagactaatctaacttctaagcaggctgcaaaacttcgatatggggtggaaggtcgcctgcagatgattacgggcaggaaaagttacctacgttattatttggatcaatttttgaacaaagagtaatgttcgtgtttttagagttaaataatttttaaactgtgagaaagatttttcttgcagttttttctttatgatttttgaagttactacgttatttattcggttaaattcttgtaattttaggttttttgtggtaaaatgtgctcaagtaatacgaaaggcgaactttaaaatgtcaaaacaattgatctattcgggaaaagctaaagatatctatacaactgaggatgaaaatcttattatttcaacttacaaggaccaggcgactgctttcaatggtgttaagaaggagcagattgcgggcaaaggagtgttgaataatcagatttcatcttttatttttgagaaattaaatgcggctggtgtggcgactcactttgtggagaaactttcagatacagaacaactcaataaaaaggttgagattattcctctcgaggttgtgcttcgcaactacacggctggttccttttcaaaacgttttggtgtagacgaaggaatcgcatttgagactccgattgtcgaattttactacaaaaatgatgatttggatgatccattcatcaatgatgagcatgtgaaattcctacagattgcggatgaccagcagattgcctacttgaaggaagaaacgcgtcgtatcaatgaacttttgaaaggctggtttgctgagattgggcttaagttgattgactttaagctagagttcggttttgacaaggatggcaagattatcttggcagatgaattttcaccagataattgccgtttgtgggatgcagatggcaaccacatggataaggatgttttccgtaggggactaggtgaattaaccgatgtttatgaagttgtttgggagaagctgcaaggtttgaaataatctgtttgcaacggaaaaccttcgtctctcaactaaaaggactcaggctgaaaaggtcccccagaccttttcactccgtaggggattgggagaactaacagatgtttacgagattgtctgggaaaagttgcagggtttgaaataacaacctcaaggtcgttggaacattgtaaaagctgaaataaaggaataaggattgatggataaacgtatttttgttgaaaaaaaggctgattttcaggtcaagtcagagagtttggtgagagaactccagcacaacttgggactttcaagcttgaaaagtattcgcatcgtgcaagtgtatgatgtatttgacttggcagaggacctgtttgcacctgcagagaaacacatcttctctgagcaggtgacagaccatgtcttggatgaagctgctgtacaggcggatcttgctaactatgctttctttgccattgaaagcctgccaggtcaatttgaccagcgtgcagcatcttcacaggaagccttgcttttactaggaagttcgagtgatgtaacggttaatactgctcaactttatttggtcaataaagatattgatgcgacggagttagaggcggtcaagaactatctgctcaacccagttgattctcgtttcaaggacatcacgacagggattgccaagcaggaattttctgagtcagacaagaccattcctaaattgactttctttgaaagctatacagcagaagactttgccctctacaagaccgagcagggcatggcaatggaagtggatgatttgctctttatccaagaatatttcaagtcaatcgggcgcgtgccaactgagacagagctcaaggttttggatacttactggtctgaccactgccgtcacacaacttttgagacagagttgaaacacatcgacttttcagcttctaaatttcaaaagcaattgcagtcaacctatgacaagtatattgccatgcgtgatgagttggggcgttctgaaaaacctcaaaccttgatggatatggcgactattttcggtcgttatgagcgtgctaatggacgtttggatgatatggaagtgtcagacgaaatcaatgcttgctcagtagaaatcgaagtggatattgatggtgtgaaagagccatggctcctcatgttcaagaatgaaactcacaaccacccaacggaaattgagccatttggtggggctgctacctgtatcggtggagccattcgtgacccattgtcaggtcgctcatatgtttaccaagccatgcggatctcaggtgctggtgatattacagcaccgatttcagaaactcgcgctgggaaattgccacaacaggtcatttctaagacagcggctcatggttattcttcatacggtaaccaaattgggcttgcgacgacctacgttcgtgagtatttccacccaggctttgtagctaaacgtatggagctaggtgccgttgttggtgctgctcccaagggcaatgtagtccgtgaaaaaccagaagcaggtgacgtgattatcttgctaggtggtaagactgggcgtgatggtgtcggtggtgcgacagggtcttctaaggttcaaacagttgagtccgtggaaactgccggtgctgaggttcaaaaagggaatgccatcgaagaacgcaagattcagcgccttttccgtaatggcgatgtcactcgtcttatcaagaagtccaatgactttggagcaggtggtgtctgtgtagccatcggtgaattggcagacggtcttgaaattgacctcaacaaggtgcctcttaaataccagggcttgaatggtaccgaaattgccatctctgaatctcaagaacggatggcagtcgtggttcgtcctgaggatgtagatgccttcgttgcggaatgtaacaaagagaatattgatgctgttgtggttgcgacagtgactgaaaaaccaaatctagtcatgcactggaatggtgaaacgattgtcgacttggaacgtcgtttcctagataccaacggtgtgcgtgtcgttgttgatgccaaggttgtggacaaagatgtcaagcttccagaagaacgtcaaacatctgctgacacacttgaagcagatacccttacggtcctatctgacctcaaccatgcgagtcaaaaaggattgcagactatctttgattgctctgttggtcgttcaacagtcaatcacccacttggcggacgctaccaactcacaccaactgaggcatctgtgcagaaattaccagttcaacacggtgtgactcatactgcgtcagtcatggctcaaggtttcaacccatatgtagctgaatggtctccataccacggtgctgcctatgcggtgatcgaagcaactgctcgtttggttgctgctggtgccaactggtctcaggctcgtttctcttaccaagagtacttcgagcgcatggataaacaagcagagcgttttggtcagccagtagcagctctcctaggctctatcgaggcacaaattcagcttggtttgccatctatcggtggtaaggactccatgtctggtacctttgaagaattgacagtgccaccaaccttggtcgcttttggggtgacgacagcagatagccgtaaggtgctttcgccagagttcaagaatgctggtgaaaacatctactacatcccaggccaagcactctcagcagagattgattttgacttgattaagtctaactttgctcagtttgaagcccttcaaaaggctcacaaagtaacagcagcttcagctgttaaatacggtggtgttattgaaagtttggcacttgctacttttggaaatcatatcggtgcagaggtgatcttgcctgaacttgaaacagctttgacagctcaattaggcggatttgtcctaacatctcctgaagaaatcgctggagtagagaagattggacaaacaagtgccaactttacactccttgtcaacggtgtgaagctagatggacacaaacttgacagtgctttccaagggaaattggaagaagtttacccaacagaatttgcacaagctaaagaactagcagaagttccagctgtcgctactaacacagtcatccaagctaaagaaaaagttgaaaaaccggtagtctatatcccagtcttcccaggaactaactcagaatatgactcagccaaggccttcgaaaaagaaggtgcagaggtcaacttggtgccatttgtgaccttgaatgaagaagccattgtcaattcagttgaaactatggttgacaacatcggcaaggctaacattctcttctttgcaggtggtttctcagctgcggacgagccagatggttcagctaagtttattgtcaatatcctgctcaatgaaaaagtgcgtgcagctattgatagctttatcgcccgtggtggcttgattattggtatctgtaatggattccaggccttggtcaaatcaggtcttcttccatacgggaacttcgaagatgccagcagtactagtccaaccctcttctacaatgatgccaaccagcacgtggccaagatggtggaaactcggattgccaataccaactcgccatggttggctggagtagaagtgggcgatatccacgctattcctgtttcgcacggtgaagggaagtttgtcgtgacggctgaggaatttgcggagctccgtgacaatggtcaaatctttagccaatacgttgactttgacggcaaaccaagtatggactctaagtacaatccgaatggttctgtccatgccatcgaaggaattaccagcaagaatggtcaaatcatcggtaagatgggccactcagaacgttatgaggaaggtcttttccaaaatatcccaggaaataaagaccagcacctgttcgcgtcagcggttaaatactttactggaaaataagacttacagattttctaatagatagtatcagtaatgtaaaagtcatgtagatttagctcttggtgctacacaaataaaaattaggtatataaaatgacatacgaagtaaaatctcttaatgaagaatgtggtgttttcggtatctggggacatccagatgctgctaaattgacctattttggtctccatagtcttcagcaccgtggtcaggagggggcaggaatcctctccaacgatcagggacaattgaagcgccatcgtgacatgggacttttatcagaagtcttcagaaatcctgctaatttggataaattgacgggaactggtgcgattgggcatgtgcgttacgcgactgctggcgaagcttctgtagataatatccagcccttcctcttccgttttcatgatatgcagtttggtttggctcataatggaaatctgaccaatgcagcctctctcaagaaagaattggaacaaagaggagcaattttcagcgcgacttcggactcggaaatcttggctcatctcattcgtcgtagtcacaatccgaacttaatgggaaaaatcaaggaggcgctcagccttgtcaaaggtggttttgcctatatcttgctgtttgaggacaagttgattgcggctcttgaccccaatggtttccgtccgctttctatcgggaaaatggccaacggagcggtggttgtttcatctgaaacctgtgcttttgaggttattggtgctgaatggattcgtgatttgaagccaggtgagattgtgattattgatgacaagggaatccagtatgatagctatacggatgatactcagctcgcgatttgctctatggagtatatctattttgcccgccctgattctaatatccacggtgtcaatgtccatacggctcgcaaacgtatgggtgcccaattggcgcgtgaattcaagcacgaggcggatatcgtggtcggtgtgcccaattcttccctcagcgcggctatgggctttgcggaagagtccgggctaccaaatgaaatgggcctcatcaagaaccaatacacccaacgtacctttatccaacccactcaagaattgcgggagcaaggggtgcggatgaaactgtctgctgtttcaggcgttgtaaaaggcaagcgtgtggttatgattgatgactctattgtacgtggaacgacctctcgtcgtattgttcaactcttaaaagaagcgggtgcaactgaggttcacgttgctattggcagtccagcgctagcttatccatgcttctacgggattgatatccagacccgtcaggagctgattgcggctaatcatacggtcgaagaaacgcgtcaaatcattggggcggacagtctgacttatctttctgttgaggggttgattgattcaattggtattgaaacggatgcgccaaatggtggtctctgtgtcgcttactttgacggtgactacccaacacctctctacgactatgaagaagactatcgtcgaagtttggaagaaaagaccagtttttacaaatagacaatagatcctccattaaagaaaaggaatataaaaatgcttatgccccacgtctcactactgactaaaaactaaagcatttgtcagtagaggctttctcctatgggacaaaagctagagacctgactagtatttttagataaaataattgtttatctaaaaatacgtcgcagtctttcccaaaaaaagaaaaggaaaaataaaatggcaaataaaaatgcgtacgctcaatctggtgtggatgttgaagcgggttatgaagttgttgaacggattaaaaagcacgtggctcgtacggagcgtgcaggtgtcatgggagctctgggtggctttggtggtatgtttgacctttcaaagactggggttaaagaacctgtcttgatttcaggaactgacggtgtcggaaccaaactcatgctggctatcaagtacgacaagcacgataccatcggtcaggactgtgtggccatgtgtgtcaatgatatcatcgctgcaggtgcggagcccctctatttccttgactacgtcgcaactggcaagaatgaaccagctaagctagagcaagtcgttgctggtgtggcagaaggttgtgtgcaggctggtgctgccctcattggtggggaaacggctgaaatgcctggcatgtacggcgaagatgactatgacttggctggttttgcggtcggtgtggctgaaaaatctcaaatcattgacggttcaaaagtggcagagggagatgttcttctcggacttgcttcaagtgggattcattccaatggttactctctcgtccgtcgtgtctttgcggattacacaggtgaggaagtcctgccagaattggaaggcaagcaactcaaggaagttcttcttgagccgactcgtatctatgtcaagggtgtcttaccactcatcaaggaagagttggtcaacggcattgcccacatcactggtggtggttttatcgaaaatgtccctcgtatgtttgcagctgacttggctgctgagattgaggaagacaaggttccagttttaccgattttcaaagcccttgaaaaatacggtcagatcaaacacgaagaaatgtttgaaatcttcaatatgggtgtgggacttatgctagcagttagccctgaaaatgtaagtcgtgtcaaggaattgttggatgaaccagtctatgaaattggtcgtatcgtcaagaaagaaaacgaaagtgtcatcatcaaatgaaaaaaatagcggtttttgcctccggtaatggctcaaattttcaggtgatagcggaacaatttccagtagagtttgtcttttcagaccatcgtgacgcctatgtgctcgaacgtgcagataagctcggcgttctgtcctatgcttttgaactcaaggagtttgagagcaaggcagactacgaagcggcccttgtcgaactcttggaagaacaccagattgacctggtttgtctagcaggctacatgaaaatcgttgggccaaccttattggcgacttatgaaggccgaatcatcaacattcatccagcctacctgccagaatttccaggagctcatgggattgaggacgcttggaatgctgacgttgcagagagcggcgtgaccattcactgggtagattctggtgtggacactggtaaaatcattaaacaagtccgtgtgccaaggttagctgatgataacattgaaagctttgaaactcgcattcatgaggcagagtacaagttgtatccagaggttattagagaattgttggacaagtaaatgaaaaaatgggtggaaacacttgccttgattaccttggtaatcattctacgtttactggtaaattttttcttcccagagattccctattgggggagatttttactgacagtaattttgggagtcttggtaatcgtctccctatattttatgaatcgaaaaatgcgtaggtaaagagtttgaaaatgaaaggaaaaaacatgactaaacgcgccttaatcagcgtctcagacaaagcgggcattgttgaatttgcccaagaacttaaaaaacttggttgggagattatctcgacaggtggaaccaaggttgcccttgataatgctggggtgaacaccattgcgatcgatgatgtgacgggcttcccagagatgatggacggtcgtgtcaagacccttcatccaaatatccacggtggactcctcgctcgtcgtgacttggatagtcacctggaagcggctaaagataataagattgaattgattgaccttgtcgtggtcaatctctatcctttcaaggaaaccatcctcaaaccagacgtgacttatgctgatgcggtggagaatatcgatatcggcgggccatctatgcttcgttcagcagcgaagaaccatgccagcgtgacggttgtggtagaccctgctgactatacagtggttttggacgagttgtcagccaatggtaaaacgacttacgaaacgcgtcaacgtttggcagccaaggttttccgtcacacagcggcttatgacgccttgattgcagagtatttcacagctcaagtcggcgaaagcaaacctgaaaagctcactttgacctatgacctcaaacaagccatgcgttacggtgagaaccctcaacaagacgcagacttctaccaaaaagctttgccaacagactattcgattgcttcagcgaaacagctcaatgggaaagaattgtcattcaataatatccgcgatgctgatgctgccattcgtattatccgtgatttcaaagaccgtccaaccgttgtggctctcaaacacatgaacccatgtggaatcggtcaggctgatgacatcgagactgcttgggactacgcttatgagtctgacccagtgtctatctttggtggtatcgttgttcttaaccgtgaggtggatgctgcgacagctgagaagatgcacggcgttttccttgaaatcatcatcgcaccaagctatacggatgaggcgctagccattttgaccaacaaaaagaaaaacttgcgtatccttgccttgccatttgacgctcaagaggctagcgaagtggaagcagaatatacaggtgtagttggtggtctccttgtgcaaaaccaagacgtagtgaaagaaagcccagctgattggcaagtggtgactaaacgccagccaacagagacagaagcgactgctcttgagtttgcatggaagtctatcaagtatgtcaaatcaaacggcatcatcgtgaccaacgaccatatgacacttggtgttggcccaggtcaaaccaaccgtttggcttctgttcgcatcgctattgaccaagctaaagaccgtcttgacggcgctgtgcttgcttccgatgccttcttcccatttgcggataacgtggaagaaatcgccaaagcaggcattaaagctatcatccagccaggtgggtccgtccgtgatcaggaatccatcgaagctgctgacaaatacggcttgactatggtcttcacaggagtgagacattttagacattaagaacgttaaagggaagaaaacagtttctttcctttttttgctttaaaagcgaaacgaaacaagattaaaacgaacgtttatggtataatattagtaaataattcgcaaaagaggttgaaagatgaagctgttagttgtcggttcgggtggtcgtgaacatgccattgctaagaagttgcttgagtcaaaagaggtagaaaaggtttttgttgctcctggaaatgatgggatgactctggatggtctggaattggtaaatatctctatttccgaacattttaaattgattgactttgcaaaggccaacgatattgcttggtcatttatcgggccagatgacgcccttgcggctggtatcgtggatgatttccatgcagctggtctcaaagcctttggtccgactaaggctgcggctgaacttgagtggtctaaggattttgccaaggaaatcatggttaaatacggcgttccgacagcagcctatggcacattctcagatttcgaggaagctaaggcctatatcgaaaagcagggtgcgcctatcgtagtcaaggcggatggcttggcgcttgggaagggtgtcgtcgttgctgagacagtcgagcaagcggtcgaagccgctcatgagatgcttttggacaataaatttggtgactcaggtgcgcgtgtggttattgaggaattccttgaaggagaggaattttcactctttgcctttgtcaatggtgataagttctacatcatgccaacggctcaggaccacaaacgtgcctacgatggcgacaaagggcctaacacgggaggtatgggagcatatgcgccagttccacacttaccacagagtgtggttgatacagcggttgacaccattgtcaagccagtccttgatggcatgattaaagaagggcgcccttatctgggtatcctttacgcaggacttatcttgacagctgatggacctaaggtcatcgagtttaatgctcgcttcggagatccagaaactcagattatcttgcctcgtctgacctctgattttgcccaaaatattacggatatcctcgatggcaaggagccaaacatcacctggacggacaagggtgtgacgcttggtgtagttgtcgcatcaaacggttacccgctagaatatgaaaagggtgttgcattaccggcaaaaaccgagggagatatcatcacctactatgcaggggctaagttttcggaaaatagtagagcgctgctatcaaacggcggacgtgtctatatgctcgtcaccacagcagccaccgtcaaagaagcccaggacaccatctaccaagaattcgcccaacaaaaaacagaaggcctcttctaccgaacagatatcggaagtaaagctattcgataaaggtataagaaaaaagcgatgcagtcgtcaagtacgttaatagtcgtttgatttgcgagcgttagcgagctaatatagaacaatcaccgctgttgtgcaagaacgattgaatgacaatacaatcgttcagggaaattggaagaccttgggcttccgatttaggcatgagacacctttggtggctgctgccgtccctcacaacctaaggtgattgaaaaaagaaaggaaagaaaaggaaaatcatgaccaaaccaattatttccatcatcatgggctcaaaatccgactgggaaaccatgcaaaaaacagcagaagtcctagaccgcttcggtgtagcctacgaaaagaaagttgtctctgcccaccgtacaccagaccttatgttcaagcatgccgaagaagcgcgtagtcgtggtatcaaggtcatcatcgcaggtgcaggtggcgcagctcatttgccaggtatggtcgcagctaaaacaacccttccagtcattggtgtgcccgtaaaatcgcgtgcccttagtggtgtggactcgctctactctatcgtccagatgccaggtggagtgcctgtcgcaactatggctatcggtgaagcaggtgcgaccaatgcggctctcttcgcccttcgtctcctatcagtagaggatcagtctatcgcgacagcactggcagatttcgcagaggagcaaggaaaaatcgcagaggagtcgacaaatgagctcatctaaaacaatcggaattatcggtggcggccagctgggtcagatgatggctatctctgctatctacatggggcacaaggttgtagcgctggatcctgcggcagattgcccggcctcttgcgtggcggaaatcatcgtggcgccttataatgacgtggatgctctgcgtcagttggctgagcgttgcgatgtcctcacctatgagtttgaaaatgtcgatgctgacggtttggatgcggttatcaaggatggacaactccctcaagggacagatctgctccgcatttcccaaaatcgcatttttgaaaaggactttctttcaaacaaggctcaagtcactgtagcaccctacaaggttgtgacttcaagccaagacttagcagatatcaacttgtcgaaaaactatgttctcaagactgcgacaggtggctacgatgggcatgggcaaaaggtcattcgctcagaagcagacttggaagaagcctatacactagcagattcaacagactgtgtcttggaagaatttgtcaactttgaccttgaaatttctgttatcgtgtcaggaaatggcaaggacgtgacggttttcccagttcaggaaaatatccaccgaaacaacattctttcaaaaaccattgtgccagcccgtatttcagaaagtctagctgaaaaagcaaaagccatggcagtgaagattgctgaacagcttaacctgtctggaaccctctgtgtggaaatgtttgcgacggctgatgacatcattgtcaatgagattgccccgcgtccacacaattcaggacactactcaatcgaagcctgcgacttttcacaatttgacactcatattcttggtgttctcggagcaccattaccagccatcaaactgcatgccccagctatcatgctcaatgttctcggccaacatgtcgatgctgctgaaaaatatgtcacagaaaatccaagcgcccacctccacatgtatggtaaaatagaagcgaagcacaaccgcaagatggggcatgtgactttgtttagtgatgcgccggatgaggtggaggaatttgggaaagggattgatttttagtacaagtctatgatacaaattatcgttaatgcatttattgaaaaggataagactggagcagtcgttgaagtcttgtatgctagtagtgatcacgaaaaggtaaaggctaaatatgaagagctagttgctctatatcctgaaaactatttagcaatttatgatttaccattggataccgatctcaatgaattactacactatccatctgtgtttattgggaaagaggagtttgagtagaaatcttgctttacctagatagcttattcccagcagtttaagaagaaaggaaaaattaacaacatgatcgaccgttactctcgccctgagatggcgaatatttggagtgaagaaaataaataccgtgcttggcttgaggtggaaatcttggctgacgaggcatgggctgagttgggggaaatccctaaggaagatgtagctttgattcgtgaaaaagcggactttgacatcgaccgtattttggagattgagcaggagacgcgtcacgatgtggtggctttcacgcgtgcagtttctgagacgcttggtgaagagcgtaagtgggtccactatggtttgacttctaccgacgtggtggatacggcctacggttatctttacaagcaggccaacgacatcatccgtcgtgaccttgaaaacttcaccaacatcatcgctgataaggctaaggagcacaagtttaccatcatgatggggcgtacccacggtgtgcacgctgagcctacaacctttggtctgaaattggcgacttggtacagcgaaatgaagcgcaacatcgagcgtttcgagcatgcggctgctggtgtggaagctggtaagatttctggtgcggttgggaactttgccaacatcccaccattcgttgagcaatatgtctgcgataaactgggtattcgtgcccaagaaatctctacacaggtgcttcctcgtgaccttcacgctgagtactttgcagttcttgctagcattgcgacttctatcgaacgtatggcgactgagattcgtggtttgcaaaaatcagaacaacgtgaagtggaagaattctttgctaaagggcaaaaaggttcatctgcaatgcctcacaaacgcaaccctatcggttctgagaacatgacaggtctagcgcgtgttatccgtggtcacatgattactgcctatgagaacgtagctctctggcacgaacgtgatatctctcactcatcagctgagcgcatcattacaccagatacgactattttgattgactacatgctcaaccgttttggaaatattgtcaagaatttgacagtcttcccagaaaacatgatccgcaacatgaactcgacttttggtttgattttcagtcaacgtgctatgttgaccttgattgaaaaaggaatgacccgtgagcaagcctatgacttggtacaaccaaaaacagcctactcttgggacaatcaagtagactttaaaccacttcttgaagcagatccagaggtaacttctcgcctcactcaagaagaaatcgatgaaatcttcaaccctctttattacaccaaacgagtggatgatatctttgaccgtcttggtttaggataattagaataaaaatcgaagttctattactctatttataggagtagaagaacttcgatttttattttgtcttcaagtatttttgataaaaattacctatattttagtaaaatttaaacaaatttagtctatcttaatttacatatagaaaatacatttttaatgtcatataataagcatagaaaaagcccaagcaaggcttaggctttcttcttagtgatcacggtcacatgaaatgaatttgattttgtagtaatctgcgcgtttatatgtttcgctgtatgcaagaacttgaccagtagactctagtttagtagtcttggtttgtaaaacggttgggaattgttcatcgactccgaggattgaagccgcatgttctggagttggaaatgctatttcattgatttcttcaaaatgttcatcattcatgtgaatgtggtaatccaatttgaaacggttatagatagagctataatattcaagatttggataatttgcgttgatgtattgttctgggatataagatgtatggtagatgtacacaacaccacccgtttcgcgaacgcgttcaatcttgtagtagaactgatctccgcgtagtccaagtttttctaagtagcttagtttgtttccacgctcaatagaaaggacggtaactttatcatctttagtttcaaaaacttctacatctgaaaactctacgagtttgtgtttgcgtgcgcgtgaaacgaatgtaccctttccttgttgacggacaatatagccatccttggcaaggtcgtttaaagcgcgaacaactgtgatagaactaacatcatacattgcaatcaattcagcttcagtgtagaatttatctccactggcaaattgaccagaaatgattttgttctttaattcatctttaatatattgatactttggaattgccatattttcacctcgattttccttctccgttaaagattttaccataaaactggaaagaatagtagccttttgaataaaaaaattagaataataggctataaggttaatttacataggaataaatagaaaaatctacatttttatacatggtactaaaatgttgttatgactataaattacaagatttttataagttttttgtgtaaaatttagtgaaaaatgaaaaaaattgtgaaaacctattgacaaatgtaagatattgagatatatttactatatcaacaaatgaaagcgtaaactttattgtcagaaggtaagaatatgacacgatttgagatacgggatgatttttatctcgatggaaaatcatttaagattttatctggcgccattcattattttagggttcctccagaagattggtatcattcgctctataacttgaaggctcttggttttaatacagtagagacttatgtggcctggaatttacacgagcctcgtgagggtgagtttcactttgaaggagctctggatttggagcgatttcttcagacagcacaagatttgggtctctacgctatcgttcgtccgtcgcccttcatctgtgcggagtgggaattcggtggtttaccagcttggcttttaaccaaagatatgaggcttcgttcctcagatcctgcttatattgaagctgtcggtcgctactatgaccagctcttgtcacgattggttccacatttgttggacaagggtggcaatatccttatgatgcaagttgaaaatgagtatggttcttatggagaagataaggcttatctgagagccattcgacagttgatggaagagcgtggcgtaacctgtcccctctttacatcagatggtccatggagagctactctgaaagctggaaccttaatcgaagatgacctctttgtaacaggaaactttggttctaaagctccgtacaacttttcacagatgcaggaattctttgatgaacatggcaagaaatggccgctcatgtgtatggagttctgggatggatggttcaatcgttggaaagagccgattatcacacgggatccgaaagagttggcagatgcagttcgagaggttttggaacaaggctctatcaatctctacatgttccatggtggtacaaactttggtttcatgaatggttgctcagctcgagggactttggacctgccacaagttacatcttatgattacgatgcccttctggatgaagaaggaaatccaactgccaaatatttggcagtcaagaagatgatggcaacacatttcccagagtatccccagttggaaccactctacaaagagagtatggagttggatgctattccactagttgaaaaagtttccttgtttgaaaccttggatagcttgtcaagtcctgtagaaagcctctatcctaaaaagatggaggagttgggacaaagttatggctacctactctatcgaacagaaacaaactgggatgcagaagaagaacgccttcgcatcatcgatggacgtgaccgtgctcaactctttgtagatggtcaacgaattgcaactcaataccagacggagattggagaagatatctattgtcaaggtaatcgaaaaggttcttcacaacttgacatcttgattgaaaatatgggccgtgttaactatggacataagttcttagctgacacacaacgtaaaggaatccgaacaggtgtctgcaaggatttacacttcttacttaattggaaacaatatccactaccactggataatcctgagaaaattgatttttcaaaaggatggacagaaggacaaccagccttttacgcttatgactttacagtccaagagccaaaagatacttacctagacttatctgagtttggtaagggagttgcctttgtcaatgggcgtcacctaggacgtttttggaacgtcggcccgaccctctcgctttatattcctcatagctacctcaaggaaggtgcaaaccgcatcattatctttgagacagagggtgaatataaagaagagatttatttaactcgtaaacctacactaaaacatataaagggggaaaacttatgacaattgtaggatgccgtatcgatggacgtttgatccacggacaagtagccaatctttgggctggaaaactaaatgtttcacgtattatggttgtagatgacgaagttgtcaacaacgacgttgaaaagagtggtttgaaactagcgacaccaccaggtgtgaaattgagtattttgccaattgaaaaagcggcagccaatattcttgctggtaaatatgatagccaacgtctctttatcgtggctcgtaaaccagaccgcttccttggtttggtcgaagcaggtgtaccacttgaaacccttaatgttgggaatatgtctcaaacaccagaaactcgttctattacacgttctattaacgtagtagacaaggatgtggaagatttccgcaaactagcagaaaaaggtgttaaattaactgctcaaatggttccaaatgatccagtttcagactttttgagtttattaaaataggaaaaaatttttaggaggtcattgttatgatacaatggtggcaaattttacttctcactttgtactcagcttatcaaatctgtgatgagttgacgatcgtttcatctgcaggttcccctgtatttgctggttttattactggtttaatcatgggagatgtgactactggtctacttatcggtggtaacttgcagctattcgttcttggggttggtaccttcggtggtgcttctcgtatcgacgcaacttctggtgcggttcttgcaacagccttctctgtttcacaaggtatcgataccgcacttgcgattacaacaatcgctgtgccagtagcagctctcttgacttacttcgacgttcttggacgtatgacaactactttcttcgctcaccgtgtggatgctgcgatcgaacgctttgactataaaggtattgaacgcaactacttgcttggtgcgattccttgggctttatctcgtgcacttccagtcttctttgctcttgcctttggtggtgcctttgttcaaggagtagtagacttggttaaacaataccaatgggttgcagatggcttgacacttgcaggacgtatgcttccaggtcttggatttgcgatcttgcttcgttaccttccagttaaacgtaaccttcactaccttgctatgggatttggtttgacagctatgttgactgtactttactcaaacgtaacaagtcttggtggcgctgttgctggtatccttggtactcttcctgctgatgttgctgaaaagattggctttgctaacaacttcaaaggtttgtctatgatcggtatctctatcgtaggtatcttccttgcagttgttcactttaagaacagccaaaaagtagctgtagcagcaccttctacaccatcagaaagtggggaaatcgaagatgacgaattctaattacaaacttacaaaagaagattttaatcaaatcaacaaacgtagcttgtttactttccaattaggttggaactacgaacgtatgcaagcttctggttacctttacatgatcttgcctcaattgcgtaaaatgtatggggatggaactcctgaattgaaagaaatgatgaaagttcatactcaattcttcaatacttctccattcttccacacaattatcgctggttttgaccttgccatggaagaaaaagatggtgtaggttcaaaagatgctgttaacggtatcaagacaggtttgatgggaccatttgctcctcttggagacacaatctttggttcacttgtacctgctatcatgggatctatcgcagcaactatggctatcgctggccaaccatggggtatcttcctttggatcgcagttgcagttgcttatgacatcttccgttggaaacaattggaatttgcctacaaagaaggggttaaccttatcaacaacatgcaaagtactttgacagctttgattgatgctgcttctgtacttggtgtcttcatgatgggtgctcttgtagcaacaatgatcaactttgagatttcttacaaattgccaatcggtgaaaaattgattgacttccaagacatcttgaactcaatcttcccacgcttgcttccagcaatctttactgcctttatcttctggttgcttggtaagaaaggtatgaactctactaaagcgatcggtatcattatcgttcttgcagtaggtctttcattcatcggtaaattcttgcttggaatgggcgcataatttatggtgaaatcgttaattttggtgagtcatggtcgtttctgtgaggagcttaaaggcagcacagaaatgattatgggcccacaagataacattcatgcagtggctcttcttccagaagatggcccagaagaatttactgcaaaatttgaagcagctattgaaggtttggatgatttcctagtctttgcggatcttctcggtggaacaccatgtaacgtggtaagccgtttgattatggaaggtcgtgacatcgaactttacgcagggatgaatcttccaatggtgattgaatttatcaatgcgagccttacaggtgcagatgcggactataagaaccgtgctgcagaaagcattgtgaaagttaatgacctgttagctggcttcgatgatgacgaagatgaataagatgtgacaacgtgaaaatcagagggaaaataggcgataggaggatggagcgattctccgacgataatcgatctttttcccaaagattttagttggaactcgattcaataagatgtgataacgtgaaaatcgttagagcattttatatagaatatacatgggaatggggcttactcccattcccatatttaatagaaaaagaggaactcaatgctacattatacaaaaggagatttgctcgaattgggtgcagaaatcactacacgtgaaatctaccaacaaccagatgtatggagagaagcttttgaatcttatcaagcaaaacgtgaagaaattgcagccttcctgcaagggattgctgataaacatgactatatcaaggtaatcttgacaggtgctgggacttctgcttatgtgggagataccttggtaccatactttaaggaagcctatgacgaacgcaaatggaatttcaatgccattgcgacaactgatatcgttgccaatccagaaacttatttgaaaaaagatgtggtaactgtccttgtatcttttgctcgtagtgggaactcacctgaaagtgtggcgactgttgaattggccaaagccttggtggatgagctttatcaagtgacgattacttgtgctgcagatgggaaattggctcttcaagctcatggagatgaccgcaatctcttgcttttgcaaccagctgcttctaatgatgctggctttgccatgacctctagctttacgtctatgatgttgacagctctcttagtctttgatcctacagaatttgctgttaagtctgaacgttttgaagttgtatctagtcttgcccgtaaaattctaggcaatgcagaagatgtcaaagaacttgttgacctagactttaaccgtgtcatctatctaggcgctggtcctttctttggacttgctcatgaagctcagctcaagattttggaactgactgctggtcaagttgcgactatgtatgaaagcccagttggcttccgtcacggtccaaaatctcttatcaacgaagatacagttgttttggtctttggtacaacaacagactacactcgcaagtacgacttggatttggttcgtgaagttgctggtgaccagattgctcgccgtgttgtgcttttgagtgatcaagcctttggtcttgcaaatgtcaaagaagtggcccttggttgtggcggtgtcttgaatgatatttaccgtgtcttcccttacatcgtttatgcccaactctttgccctattgacttcactcaaggtagaaaacaaaccagatacaccgtctcctacaggtacagtaaaccgtgtggtacagggtgttatcatccacgaatatcaaaagtaatactcttcgaaaatcaaattcaaaccacgtcagcttcgccttgccgtactcaagtacagcctgtggctagctttctagtttgctctttgattttcattgagtataagacagtatttatgaattcttgataagaggatttgtaaatcatacaagtaaaccatagattgtgaatggactttctatggtttgtttgcttaatagaattaggaagaaggaaaaacgaatgaaagcatacacagagcgtgtgttcggaagagttgatgaacaagatgtcctagcttattgctttgagactgatgctggttatcaattagaggttatgacttatggggcgactatcttgcgctatgtaacacctgacaagactggaaattttgccaatgttatcttgggattggatgactttgacagctatgtaggcaatagccccaagcatggagctagcgtaggtcctgtggcaggccgtattgcaggtgcgacctttgagcttaatggcaagaactatgaccttgaagtcaacaatgctagcaattgtaaccatagtggttcaacaggttgggattccagcttgtttgaagttgaagaagtaagcgatcatggcctgaccctctacacagagcgtacagatgggacaggaggatttcctgggaatctcaagatttggatcagttaccacttggaagaaactggtgcctatgaaatcagctacaaggtaacgacagatcaggatacgctggtcaatccaaccaatcacagctatttcaacttgtctggtgatttcacgcagacgattgaccgccatgtcttccaactaaacacagagggcatttatccaatcgctccagatggagttcctgccaaaactccagatgctactcgtgatgtggttaaacacatctacaatggtgccttgttgaaggatatctttgcagaggacgatgagcaaatccagctggtatcaggtttggatcatccgtttgcccttcctgcaggtcatgacaatgctggattcctttatgaccaaaattcaggtcgcttcctgcttttcaagacagaggcttcttgttttgtagtctacacagcaaactttgtggatgaaagtgtcatcataggaggtcagccaatggtacagcacaatgggattgcccttgaagcgcaggctttaccagatgccattcacagtgacctcaaagaccaagtcattctcaaagcaggtcaaacctttacaagcaagacacgttatgagcttgttgtgaaataaaaggataggaatttctacttttttgggaatagtatttaccttataacattagtagaaatgggcaaagaataggaaaatatgatataatttaatattgaaaatacctgtcctatctaaaggataaaaggagaaaaaaatgaagaaaattgtatttgctagcgccttggctttgactttagctggagcagttttgacaaatgatgtttttgccaatgacagacttgtggcaacacaatctgcagatggtagaaatgaaaatgtcttgagttcagaagtgcttaaccctgctagtggcaatgttttggttggattaaagggagaatttttgactccagaccaacaagctatcttagatgccatcaatgctatccgtaaagaggcagctgacgaaggtttggtagataagtatgtccctatcaaatggtcgactgacctagaaaaggcagcttttgccagagctgcagaagcttctgtaaccatggaccatactcgtctttctggtaaagaaatctggagcgccttcccatcaggaaacagtgtactaggagaaaacttgggttggaaccatgatggttttctaaaagctcttgaacaatggcgtgctgaaaaagcagactacgtgaagaaaaaatcaggtgattcagcaaaaggtggctctggtcattatgaaactttgattagccctaaatttacacatatggggattgctgcctttaagaatccaaacaacccatataatgccgtaacgattgctcaggcttttggtgatgctgctacttcagaagaattggtaggcagttacggtccggctatccagtatgcagaagtgacttcatctaacttgtcaacagttaaaaataaagcagtcgtagttgaaaaagcgctgaaagaatttagaacttctagttcagaccaatctggttgggtgaaaacagatggaaaatggtatttctatgagtctggtgatctgaagacaggctgggtgaaaacaggtggtaaatggtactacttggatgacctaggtgtcatgcagacaggatttgtaaaagtagatggtagctggtattacttgagtagctcaggtgctatgtttacaggctggggtacagacggaaatagatggttctactttgatggctcaggagctatgaagacaggctggctcaaagaaaatggaatctggtactaccttgatgcgtctggtatcatgaagacaggttggtttaaagttggccaatactggtattatgcatatggctctggagctttggcagtcagcacaacaacaccagacggttataaagtaaatggcaacggtgaatgggtaaactagaaactaaagagttgctttcataactttagataatctatatttgttactataattttaaagatggagagaagaaatagtgcttctcttcattttttgttgacagtttatttctgaaaaatcgtaaagtaagtgtggtgggaagttcgtcttagctttttcaaatcagttaattacttagttacttgatttttcccatccgttcaattgtatatctatccctagaatcttttaaaaagttgatgtataatggaaagagttgtatattttacaataaattaacatactaatttaaaaatgtaaaaagaggggaatatgaatttcaaaactagtggagaagaaagacagaatttctcattaagaaaattggcagttggtcttgtatctgtggcagttgcgtgtttctttttgatgggaactggcctacagactgtatctgcccaagaatctcataccgttaattatacttatgttttagagtcggatttaactgacgaagagaagggtctcttggttacatccctaccacaagtagcggaagaaacagacgctacctactatctggtttatcgagcaaatcaagtattgcccaatacgggtactagctctccattggggactgttgccttggtggcaggtcttagtttgctggttgtagtagttcttaagggacctgatggcaagagaaagattagtcgattcttgttagtaacagctctaggcagtcagttgctgtctccaactgtccttgctttgacgagcgagacactagctgcttataacacccaattatcggtccaggcaggagatgccttgccagctccggttgatattcctggttatacttatctaggatatgtggaaaataagccagctctttctgtacagataactagcaaaccagcagaatctactgaaaatcaagagattaaattagaaaacagtcaatctcaggaagtagttactactcattcagcagattcgactatgggaactgaatttgtcaagcagtcaaatgacagcaagtctaacttagaaaatgtagatatctcagcagctacggctccatcttctaaaaatgaggatactagtcagcaaccagcagtttctctaagtcaggaaagcaaggatacgaatgttgtcaaaggcggggaggcagaccaaaaaacagcaccagctacagagtctgcaacaaattcaagtcaaactgatgggaatcaagaacagacaaatcaagtaccgccagcttcgcaaagcccagtggtagagaatcagcaaggaggaacatcttctcctgtagagcctaaaccacaagaaaataatgaaactgtagtgcaagcaaaagggacacaagagtcaggtcatgagggcgaagccttaatccaaccatcgcaaccagcgtacacagccccaattagcacccaaggtacccaagagtcaggtcatgaaggcgaatccctagtccaagcagagcagccgtcttatacagctccaattagcacccaaggtacccaagagtcaggtcatgaaggtgatgccctggttcaaccatcgcaaccgtcttatacagaacccgttagcgctcaaggtacccaagagtcgggccatgagggtgatgccctggttcaaccagcacaaccgtcttatacagaacccgttagcacccaaggtacacaagagcccggccatgaaggcgaatcccttgttcaatcagaactaccagtttacacaggtcctcaggagggagctccagttgagccaacagtgccagagtctacagaagttgttagcagtaagggcacgcaagagcccggccatgagggtgaagccttagttcaacccgttcagccatcttacacagccccaattagtacccaaggtacgcaagagcccggtcacgagggcgaggctgctgtagcagaggctcttcctgaactgcctttgacaagtaatcatcgtacagtaacagaaaccattcctcatgaaactgaagaaattgaagatgcgactatcttaaaaaatcaccgagaaattgctcaggaaggaaaagacggtttacgaacaatcgagtatgaagattatctcgtagatggtaaggtagaagctagcaaggaaatctcacgtacagaagtagaaccaaccaaagagattgtcaaggttggtagtcttgttaaaaccaaaccaatagttgaaattactaatctggttaaagatgagagcaaaaaagcagtagcagtcaactatcacttagatgacccaacgtctgcctttgtgaaggccaaggcccaaatttaccaaaatggaacactggtcaaagaggtgaacttgaaaaatccatcagatcaacaaacgattgatggattggactactatacgtcatacaatcttaagacttacctgacctataatctaggccaatctgatcaggaaagtacagaagtatcaacgaaagattttcagttagactataaaaaaattgaaatcaaagatgtggatgaagtggggctctatggtaaggaagatggtcactaccgtcgttatctgaacttatcagaagtaccaagtgatttgtcaccttattttgtcaaagtcaaatcagacaagatgaaggaaatgctgttaccagttagctctattaaggaaacagatgatgggaaatacaaggtaaccgttgccttcaatgaactggttcaagaggaaggttcaacatataaggataactatagtttcacaattgataagcaaaagcttgccaaggacggtgtctatacttcctttaagaaactgattgctgctatgcaaggcgatctcgctggaacctttaaacttggagctgatatgacagctgatgaagtttccttagctaagggacaaaccagctatgtgacaggcactttcactggtaaccttatcggtgcgagcgatgggcagccgtttgcaatctatgacctcaagacagccttgtttgataacttgaccaaggctactgtgaaagatattgaccttaaagcggtagcaattaagagtcaagaagacacagccagcctagcaaaagtggctactaacagccagattagtaatgtagctgtagaaggtcaattgacaggtagcaagtcagttgcaggtttggtagccaaggctcaggatacagaaataactaatagttcctttacaggtagcattcaggccaagcatgcggatgcctctccttactatgtgggaggtatagcagggctcttatctggtaataaggctaagattgataaggtagccgttgatgcaaatatttctagcaatgctcgcaacaataaccaatttgcgggaggtattgtagggaaagttcaaagtggtgctttggtgtctcatgcgctagcaagtgggactatcctcaatacgacaacctatccacgcgtcggaggtatagctggttctacatggcaaaatggccgtatccatcatgttgttagcacggtcaatactggagacggctatgccatcacaggagaccaatataagggagcggacatcaaagatgccagcactgccgagaacaagaaggccgatctctatgcgaccccaatcacccaagaccaggccagagaaaaggtccagtcttatgggatgacagtgacactaaacgatacaggtcaaacactaaaggccaatcagcacagtgtggactatactcagttaagccaaggtcaagctagtcgaaaagttgcttatcacaatatcgagaaattgatgcctttctataataaagagctagtggttcactatggaaatcaagttgatcctactgataagctttatactacagaactgttggatgtcgtaccaatgaaggacaatgacatcatcacagatattcaggccaataaagtagcaatcaataagcttatgttgcattttgctgacaatacaatcagttatctagatgtcacctacaaagaagacttcaaaaatacacaaattgcagagtacagcgtagcaggtaaaccctttatctttacgccagaggcctttctatctgactatacaaaagtgaccaatcaggtcctagcagatttgcaaggggttgaatatgactcagaagccatgagaaaagtccttggcattgaggcagatgcttcacttgatccactatatttggataaagaatttgaaaaagttaaggccaatatcggtgaacatctccgtaaagtgctagccatggacaagtctatcaatacgatgggagatagtgtagcaacctacatcagcgagaaaatcaagaacaacaaggaagctttcttgcttggtttgacctacctcaatcgctggtacaatatcaactatgatcacatcaataccaaggatctcaatacctataagtttgactttgatggtaatagcacagcttcaaccttggatactatcattgcactaggtcagagtggtatggaaaatctcaaggcatcaaataatccaagtgcctatgaaacaaccctggctgctgcaaaaggtcgcaagacagtgactgatttactagagtcttacagaaaactcttcctaccaaacaaaaccaataatgaatggttgaagacaaataccaaggcctatatcgtagagagtaaatcagcgattccagaagtgcgtgccaaacaagagtcagcaacaccagatagtaactatacgctgggagtctatgaccgtattacggcaccaagttggaaattaaaaaatatgctcctaccgctattgacattgccagaagaggatgtttatgtgatttcaaatctttctaccttggcctttggtggctacgaacgctaccgtgaccgtgtcaataatacagtcttgtcaggagaagaactgcgtcagtatgtccgtgctaaggtcgaccagtcggctaaatggcaacgagaccactacgatatctggtaccacctccttttaccagaatacaaagaaaaactcttccgttcagtcatggtttcagatggctttggtatgaaagatagcaatagcaagtattactggactaccctgtctgataaggccattgattctatctacaacttctttggaccaactggtaagtggtatggggaaagtaaaggagccggggcctatgccaacggttctgaggtccactatgtcagcgaccgcttattggataaatatggaacatctgtctatacccatgaaatggttcataattctgatggacatatttactttgaaggtaaaggtcgtcgtgaaggattgggagcagagttgtatgccctaggattgttacaatctgctgatagtctagataaggatgctattgtcttgaatactctctataaaggggataaggattcaccaactcgcttgcatacttatgacccggcaagccgcttcacatcagccgcagccttgcaagagtatgtgcacggtatgtacgatgtcttgtataccttggacgctatggaagccaatgccattttaactaagtctaacgatgtcaagaaaaaatggtttagaaaaatagagaatttctatattgaggacaagtatcataaacaaacgcatgcaggaaactctgttcgcccattgacagatgctgaaataagtaagctaactagtctggatgccttgattgacaatgacatcatcaaccgtcgggcttaccgtgataagagtgactatactcgtaatggctatcatcttatcagcatgttctcaccgatttatgctgccctcagcaatccaaagggtgcacctggtgacatcatgtttagaaaaacagcctatgaattgttggcagaaaaaggataccaagatggattcttaccatatgtatccaaccaatacgcagaagaagctaaacgaaacggggacattacctattcagattggcacggaaaagatgtgggagtcatcactgatagtttcgtcttgaaaaatgtctttgccaaccaatatggttcatgggctgatttcaagaaggatatgtttaataaacgtattcgcaagcaagaccagttgaaaccaatcaccattcagtatgaacttggtgtaccaaacagcagcaaggagattacaattcgttcagcagcccaaatgcaagaactcatcgatcaagcagtggcaaaagatgtggctaatattgaccgtacgacaagccatgctcctgcaagttgggtacacttgttaaaacaaaaaatctacaatgcctacctacgtagtacagatgatttcagagaatcgatttataaatcataaggaaactccctcacgctatcctgtctaatccagtccatcttgcagatggtcggtctttgtgatagaatagcataaagtccttttgagggggaacttgctaggaaatccccaagcattgtaacggatgaaccaccctcgcctttttgtgagggtggtttttcgtttgtaagtagaaaataagagagaaagagtctacatcatgtcgagaattgtcaccattcatccagtcaaggaaatccatcgctatggctttgagagtacccaggtctatcgagcccgtatcgcacgacatctaggcttagactacgtccacctcatgtcaagtccccagctacgatctgattggaagaaagacttgatcaagttaggatttttagaaaaggaattgctctgtgttccgcatagtttttcagatataggccatgtagacttatcagtgaagccagaaagtttaacgctagcagctggtgatcaggttgaactcaatgaggatggttttgtagcctcagttaccctaggagatggctcggggagatattactataccaaggggcccttcttgtttgaagattttaaggagaaggaacttcgttggtatcatgaaaatggagaactggccctggaaggacgctttatcaatccctttaaagaaccctctcctgtaaccatcttttatccagagtatatctaccgcataggaggagaaatccgttctgaagaggacttgctggttaagttcttagccagatgggcaaaacaaaccgacctcttcatccgcgaccaacaaatcgttcccaaacccagcctctggcgttatatggaaaacacggacaaaaattactatgaagttgtccatgaaaatatcatgcgagacttacgcctcgccaatatgcacaagacaaataaatatctagtcgccagtgaagtgttgactgataccttggcgaaacaagggtatgataccaagtttttaccaccaatgtttacagaaaaattaggtcagctaagaaaaattggacctgttttggactattgcttggtgggccatatgggagaaggcaagaacgttgaacttgtcattgaagcctttatcgaactctacaaacgtggctccaaggcccagattaccttttatggtggctcagaggaacgtctagcagaattacagaatcaatatgatcttccgccaaccattcactttaaaggtatcgttaacgaagtgccttatcatctgcaccaatgttacctgtcagctagttatacagagttatttgccaatgcctgtgttgaggccctcaatcaaggtttgctagccttactatcggatgtggatattgctcatcgtttctatgctggccagtccaatgccatcaacttgtttaaaaccaaatcagagttgattcaaaagatagaaaagatggaacagcctggtttttatctattaaatgaaaaaaatctagctttggcctctcgctattctctggaaaaagtagctcacatatacagagagctattagataggaacttctaggatgttgggaattctagtcaccctattgctctatttttgcttgatttccttgattgcctatcggaaaaaagggagcgaagaggactattatcaggttaagaaagctgttccagtgacagttttggccttctcagtctttgccaccttactcagtcccatttcctttctgactctggtggggaatgtctatacaggcaggtcctatctctggtttgcccaatgtggcatctttctagccattccactagctcatcgctattttctgcccctctatcaaaagggaaactatgagacagcctatcatcttttagaggacaagtttcaatcgactggcattcgttcactggcctcaggtcttttcatcctctaccagttggggcgaatagcagtggtgacctacttgttgtctcaggccttagagccttttatccccatcaatcagctggtcttgtcaggtttactccttctcttgacggtctattatctggcaaggggtggtctcttggttgtgctgtggacggacttctttcaaggcttggtcctactggctatattggccctctttctaccaagaattgcccaatcaggcctcgtcgtgaatggcagtcaacagctatctcactttgcggatacgctggatgggaagacggtcttgatcttagttgcaggagcaggttttagtagcttgttttcctacgtttcttcgcaggatatcgttcaacgttttaatagcaaaatggggcgtcgaaaaattggaaaaatcttatggcttcagggactcttgtcctttgggattgccagtttgctgtatctgattggctgcttaattcgtcaggaaaatttcgctaccacatcgaccaatcctgttctcattgcttacgctcgagaaggtctggccccttggtttggcagttttatcatgctggctctcttggcagcaggccaatccacagtttcatccagtatgaatgcaatcgtgacctgcttgaagttggattttgcttggtcaaagattcgctggtcgccaagtatcctatcctttgtcttagcaggcctgtcctggctcctctgtctcttgctcatgaatgcagaaatttactccatctacgaatggattaacggctttatgggcttgacactaggtgtgataggtggtttgtacctcttggtcttacttctcaaaagaccgaacttacagttagccaaaatctatctggtttttagtctaggagccttggttctctatcattacagtggcctttttgccaaccctaatccctggttaaatagcatcatcactaccctatctgccctgtttatctcatttctaggaagactatatgaaaacaacatctaaacccatagccgtcattttgatccgttcgggttcacgcggcttagtggataaaaatatcaaaccgcttgcaggcaaacccttggttttctataccatcgaagtcgctctagcttctaagctatttagtgaaatctggatctcatcagactcactagcctatctagaactctgtcgtcaagcctatccagagattcgttgtgtccatagaccaaaagaattggccctatccacaacctctagtttagaaaccttacgagactttttacagccctttgaagaagagcaggtctttgtgaatctacaggtgacctcacccttgagggaggtggagcatcttatcgattcctaccagctctactgtcagtctggcgccgaccatttgatttcctgtgttaaggcggacaagagtcgtagtcttttcttgcagttagcggagtcgtcatttatccgcccgcctcacgtttccaagcactatgctcggcaaaaagagcctgtctattactatcctaacggtagtatctggatttctcgcaaggaccgttacctacgagacgagaccttttacacagataagacagtagcctatgaaatgcccaaactctattcttatgatatcgacgatgccttggactttgaagtcgttgagaccttgctgcaccatcaccacctaggagaatcaaagagatgaaacacctcatcattgccacaacgcccttgcaggccaagattgcccagcatatcaagagcctctatcctgatcaggaatttgtcagcctttatgtcagtcctgtcaaaaatgcccgtcaggagcattatgccaaggattttgaccatgctcactatcctcagacggcagaggacttggctcagatttgtcaggagcttgccggcgactatgacactatcttttatgctagttttgacaatagcttgattctggacttggttgctagttcgacctaccaacacctcatgagttttgatgatggctatgcggatatttaccccttgggtatgtatgccctccctcttcaacccagtcaggtggggcctttgggcttgactagagatgatttgattgagcggacggaaaagcactataccctctatcgcagtgactaccatgtcgtggctagagaaaagctagtttatctggagcatttttttgacctgcctcaagctcccgtttcaaatggtaagacggtcaaggtcctgctgggacaaaagttctctgaagaggacgaccagatctccatccgctttatcagcacttatgccaaggccttggcaattgacctctatctaccccatcccaaggaaaccttcactatccctgatgtgacctacttggagacggagttgatctttgaagatgttctagcccaactctttcaagaatacgagttcgttcatgtctatcattttacctcatccgtcagcctgcaccttaaagacctgccccatgtgaccatcacaggtatttctctcccctactatgaggaccgtcaaaaagaattgcgacgattaggttgtcagtttgaaatagtttcacttggctggtagtataaatgtatatttttaaatatgtaaatccatacatctgtatggattttttatatataaatatagcgaaaaactatagtttgaatgatcaaaaagtattgagattatttgtatagggggttttaaagtgttaaaatagaagtgtcgggttttcaggtttatcaattgttatggctataataatataataatctttgaaaatcatacaaaaaaataaagataaaggatgctaaggatgtttataaataaaaaggaaaaattttccatccgtaagtttaaagacggtcgttcagactcagtcaaaatcggtacagttgctctgattgttggtgcagcccttgcaatggctgctggaacgcagacagttgaagcggcaatgacagagaacagtgacaacacaacaacgatttctaatgataagggatcagtaactgtagatactggaaatattaaggatccgaataatggtaaggacttttcaactgatgcaactgataatgggacaaaagaaattacaaaaactggaaaagtagattacaaatacgtaactgctgaaggaaatactgtattagaagaaaacaaaaaccaaaactctggtgctgataaaactatcgaaacaacatatgatgtatacggtaaatcaggagaagttttcaaaggaactacaggtggggatgcagaagatagcgacctaaacgacgctaaagaaaatggtaagaaagaaacaattgaaaaagatggaaaaacttaccacctaatcggagagcctaaagtcgaaactactggagatggtggaggagtatactctgatacaactctaggtgatataactgcgaaattgactccagaaggattaagtaatgcagaaggtaaaattacctatgataatgtaaaagctggtggaaaagcttggattgttgaacaaacaggaaaaggaacatatggtaaatatgtacaagctgattcaggtgctatcacatctgatgctaagatggtagaagctttcaaagctggagaagcggcggcgaaaaacttcacttcagctaacgtaactgctgacggtggaatcaaagaaggagactacgttttcgttcttgagaaaaacacttatgtaactgttagtaacgatagtcctcaattaactgctatgatacctttatcgcctaaggacaatgtagctgatgacgccgatgacccttatggagaggggactggtgcaagtctagatagaacatatgcaatggttcaaaaatttaaagcggcgccagatactttaacaggtgaaaacaacaaaactgttgtaaaagggtatcttgcttatcttcaagaaaaaggattagaagataacatgcttaactttaaacgatattttgttgtggggctagaagcaaaaactggtgtagaatccgcaatagcagttgataatggagatcaagttgatgctaaaggaagaccgacatcagatgtaactgtggattattcaggggtttctgagtcaggaacaactgctatagatggtggaaagggtgattttactcttaatcttagttctcctgatgcggaagttgaaacatacacttaccgtgatgaaatcactccacttcgtgcatatcgtttagcaagtggtactacaacaatcacttatacttatgcagaagaaaaaactcgtgaagtcgagaaaaaaggttctgtagtcgttaactaccaaacagaagacggaacagaattaaaagctccttacactgatactcctgaaacagtagctgaagtagtaactgagcattactatgttgatgctgatggacaagaagtagttgtagaagacaaaactgttagaacgcctaaaaacgtagcctacaacactaagaaaaatgaaactgaaaaacctcaaaaacttacagatgcacaaggaaatgtttactacctaaacgaagcaaatacaacaacatctgtaaatggtacagaaactacatcgccagctgaagaaggtacagtagtagaaggtgttacaaaagtaacttacgtttacgaaaaagctggatcagtcatcgttaattaccaaacagaagacggtactccattagtaggaactgcagacggtaaagatgtagcttcaggtgcaaaagacactgacaatggaaaaccaggttctgaatacaatactgcagataacggattgaaaccaaaccgcatcacaactgcagaaggaaaagtatacgaactagtaccaacagcaactaaaggtgacgaaacaggtactgtagaatcaggtcaaactaaagaagtaacctacgtttataaagaagttaaaggtaatgtagttgttaagtatgaagatactgaaggtaacacacttgctgaagacgaaaaagatgaaacagatgcttctctaaatgttaaatacgatacagcagaccacaaaaaagctgaaatcactaaagatggtgttaaatattacttaacagctaaagaattgaaagatgattctaaaccagctactggagatgttgttgaaggtacaactacagtaacttatgtttatgaaaaagctggacaagtagtcgttaattaccaaacagaagatggaactccattagtaggtgttgacgcggatggtgcaaacgttgcttcaggtgctaaagacactgtagatggaaaaccaggatctgattacacaactgcagacaacggaatgaaaccaactcgtatcacaactgcagaaggaaaagtatacgagctagttccaacagcaactaaaggtgacgaaactggtaaagttgttgctggagaaactaaagaagtaacatacgtttataaagaagtaactggtgatgtagtcgttcactacgttgatacagaaggcaacgtaatcgctgatgataaagaagatacaaaaggtgcttctctaaacgctaaatacgatacaactgacaacaaaccagagaaaatcgaaaaagacggaactgtttactacttaacagaaaaagctgtcaaagacgattctaaaccagaaaacggagacgtagtagaaggtaagactgaagtaacttacgtttacgaaaaagcaggacaagtagttgttcactacactgatgaaaaaggtaacactattcaagtggatgctgttgataccaaagacggcaaaccaaacgctgactacaacactgctgataacgacatgaaaccaaaccgtatcactactccagaaggaaaagtatacgaattaatccctcaatcaactaaaggtgatgaaacaggtaaagttaaagctggagaaactacagaagtaacttacgtctacaaagaaatcactggtaatgtagtcgttcactatgttgatacagaaggaaacacattagctgaagatacgaaagatgtagaaaatggatcactaagtgataaatatgacacaactgataacaaaccagctaaacttgaaaaagatggtactgtttactacttaacagctaaagaattgaaagacggttctaagccagaaaacggtgcggttgtagaaggaactacagaaatcacttatgtatacgaaaaagcaggaaacgttcttgttcattacgtagacgaagctggaaacactcttcaagcagatgctgttgatactaaagacggtcaaccaggagctaaatacgatacttctgataaggacatgaaaccaactcgtatcacaactccagaaggtaaagtatacgaattagtcccagcatcaactaaaggtaacgaaactggtgatgttgaagcaggtaagacgacagaagtgacttatgtttacaaagaggttaaaggaaacgtagtcgttcactacactgatgaagcgggtaacacaatcgctgaagacgttaaagatacgactgacggatcagtaagctcagcttatgacacaagtgacaacaaaccagcaactatcactactaaagatggtaaagtctacgtacttgtaccaacttcaactaagggtgaagaatctggtaaagtaaccgaaggaactacagaagtaacttacgtttataaagatgccaaagaagaagcttctaaagcaatcgataaagctttgtctgaaaaagaaagtaagatcaaagaaaatcctgagttaacaaacgaagagaaagaaaaagcgattgaagaagctaagaaaacagctgaacaagctaagaaggcattggaagaagcgaaaactcctgaagatgtagaaaaatctactacaaaaggtaaagaagaagtagagaaaactcctgttactccagaagacaaaccaaaagcgaaagaagcgattgataaagctctagaagaaaaagtgaagaagattgatgaaaatccaaacttgactccagagcaaaaagaaaaagctaaagaagaagctaagaaagatgctgaagaagctaagaaagccatcgacaaagcaccttctaaagaagaagtagaaaaagctaaagagaatggtaagaaagaagttgagaaagatactccaactccagacaaaccatcaactccgtcagaaaatgataaggatcagccaactacaccttctccagaagataaagcaaaagcgaaagaatcgattgataaagctctagaagataaagtgaagaagattgatgaaaatccaaacttgactccagagcaaaaagaaaaagccaaggaagaagctaagaaagaagcagaagctgttaagaaatcaatcgaagaaggtaagacaactgaatgggtagacgaaaaaggaaacccaatcaaacctgtaacaccaggaacatacccagcaggatctactcctaactatgaactagtaggaacagttacaaacaaagaaacaggtaaagtaactcatatcttcaaaccatcaactaagaaacctgtaacggtatgggtagatgtaaatggtaagccagtgaaaccgctagctgaaggtgataacccagctggatcaattccaggatatgctttagtagaaaccataaatgttgaaggaactggtaatgtcatccacgtatttaaacgtactacaaatggaagacctcaaaaagaagattctacacatggaggatcactcactccatctcaaccaggttctccagcaagaccttcaacaaatccggtgagaccgacagacccaagtcaaccagaaactccagtagttcctgcagacccaagtcagccagctaacccagctaatccggctaacccagcgggtccagcaactccagcgatgccatcggcaccagtaaatggtgaagcaccacaagctccagcagctccatcagaagctaaaggacaagctgaacttccaaacactggtacagcagataatgctagcctagcagcacttggacttcttggagtcttgagtggatttggacttgttgctcgtaagaaaaaagaagactaattctaattagattttctgacaagaataaggagtaggatatcatatccgctccttttctttttgggttgagataagagtcatcatagcattggttaaaaattttcggtggttttattgtcaattctctgtaaatttttctcgttctaatcccatatagacaagatggcagaatcataatctataagttgtctggcttgactttcttgatgggaattatataatagatgtaataaaaataattacaaccgagaaagaggaccatttatgacctatgaatacaagagtcacatttatttagcagaggcagttttaaatgtaaaggatttggcaagtcaaacagccttttatcagcaagtgcttggtttagaaatcttatctcaaactgagacagaggtcgttctgggacttggaggaaaagccttggtacacttgattcaaacacaagagagcggtgaagtaagggaacattatggcctttaccatctggccattctcttgccgacacgaaaggctttggcggatgtcttgaagcacctgacagatttacagattcctctagttggcggtgcagaccatgggtacagtgaggctctttacttggaggatttggagggaaatggcattgaactctatcgagataagccggtttccacatgggatattcgagaagacggacgcattatcggagtgacggaggctcttgcggcgcaggacatttatgagctgggggaaagagtagagccctttatcctggcagaaggtacgagaatggggcatattcatctttccgtcaaggatagtcgaaagtccagccagttttatcaaaaggtgttagggttagaggataaattcagtgtgcctagcgctagttggattgcagctggggactatcatcatcatttggcagtcaacgaatggggaggaaaaaatctggctccgcgtaagcaagacttgccaggtttggcccattatgttattgaggttgctagtaaagaagaactgttaacgattgcccagcgagcacaagaagttgatgcaccaatcaaatggctgacatcaagccagttggaaatcacagacccagacggaattgtgactcgtatccgcttagacaggatatgatgacaatcagagtataaattgtggaaagtgctccttatcctagtcagatatgtaaaaaatttgatatgatagtagggaacaaggagaagaaaacaatgaccagtgaataccagaaaatgatagcaggagaggtttaccgtccatcggatccagaattgcgagccttggctcaggcttctcgccaaaaacagtctgcctttaacaaggaagaagatcctttgaagggagtcgaaatcatcaagatctggttcggctcgactggacaaaatatctttgtcaatccacgcctggtggtcgattatggggtcaatattcatctaggggaaaatttttattctaattggaacttgaccatgctggatgtttgtccgattcgcatcggggacaatgcgatgattggtcccaactgtcagttcttgactcccctccatccattggacccgcaggaacgtaattcaggtgtggaatacggcaagcctattactatcggagacaatttctgggctggaggtggtgtcattgtccttcctggagtgacattgggtaataatgttgttgctggagcaggggctgtaatcactaagtcctttggcgacaacgttgtcctagctggtaatcctgcgcgtgtgattaaggagatatctgtgaaatagaagtaaaaaggaacagcggaggttgtttcttttttgtaggtttcatcatcttttactcagactacatttacctactctatctcttagaaagtttgcttcattgattaatttaaaagcatctcgtaactgggatgcttttttctcctcaatttatcagcctcctccttgacactcagtcagcttttgatacaatagtacaaaattagaggaggtgggtcatgattcagaaacatgcgattcctattttagagtttgatgataatcctcgtgcggttatcatgcccaatcacgaggggctagacttgcacttgccaaagaagtgtgtctatgcttttttagaagaggagattgaccgttatgcgagggaagtaggggcggactgtgtcggcgaattcctttctgccaccaagacctatccagtctacgtcatgagctacaagggcaaggaggtctgtctggctcaggctcctgttggttcagctccagcagtccagtttatggattggttgattggatatggtgtggagcagattatttccactggaacctgtggtgtactggctgatatagaagaaaatgcctttctagtccctgttcgggctttacgagacgaaggtgctagctatcactatgtggcaccttctcgctatatggaaattcagccagaggctactgctgctattgagcgagtgttggaagccaaagggattccctatgaagaagtcatgacctggacgacagacggtttttaccgagaaacggctgaaaaggtggcttatcgcaaggaagaaggctgtgctgttgtggagatggagtgttctgcgcttgcagcagtagcccaactgcgtggggttctctggggagagttgttgtttacagctgattccttagcagacttggaccagtacgatagtcgtgactggggttcagaagctttcgagaaggccttggaactctgccttgagatagcctttcagatatagctactctcctactttttatggtacaatggatgtatgttattcaaattatttgtgaaaaaaattgagagagccttgggcggactttcgccagctcgtcgcatctttttaagtttcgctggagttatttttataggctctctccttttgagtttgccttttgtccaagcgagtggttcgcaggccacttattttgaccatctttttacgacggtgtctatggtctgtgtaaccggcctttctacgcaaccggtagctactacctataatgtctgggggcagttgatttgtatgctcttgatacagattggtggtctggggctcatgacttttatcggggtcttttatattcaggggaagcaaaagctcagtcttcgcagtcgtgaaactattcaggaaagctttagttacggggagactcggtcgctgaaggcctttatgcgatctatctttttgacgacttttctagtggagggcttgggtgcctttctactaagtttccgttttattcctgagttcggctggggacgaggcatttttacctctatctttttagccatttcagccttttgtaatgctggttttgataatttcggcagtagcagtttagtggcttttcagacggatcccttgatcaatctggtcattgctggcttgattatcacgggtggtcttggctttatggtctggtttgacttggcaacccagtttgacaagaagaaaaaacgccgtctgcgtttccacactaagctggttctcttcttgactgcagggatcttgctgtttgggacagtatccacactctttacggagtggcacaatccaggaacaattggcaatctcagtgttccagagaaagtgctggttagctttttccaaaccgtcagcatgagaacagctggctttgcttctattgattacactcaagctcggcctgtgaccttgtttatctatatcctacagatgtttctgggtggagcgcctggagggacggctgggggactcaagattacgactttctttgtcttgttggtctttgcgcgtagtgaattgctgggcttacctcatgctaatgttgcgcagagaaccattgaggtccgaacagtccaaaaatcctttagtgtcttcattatctttttgatgaccttcttgttgggcttgatgttgttgggaattacagcagaaggaacaccgcgatttatttacctcatgtttgagaccatttcagctcttgcgacagttggggtaacggcaaatctgacaccagaattaggcaagttagctcttagcattatcatggtgctcatgtttattggccgtatcggtcccttgaccttgctggttagtctagctgactaccagcctgataagaaagatttgattcagtatatgaaagcagatattagtattggataagaaaggaagaatgatgtcagatcgtacgattggaattttaggtttggggattttcgggagtagtgtcctgacagccctagccaagcaagatatgaatatcattgccattgacgaccacgccgagcgcatcaatcaatttgagccagttttggcgcgtggagttgtgggcgatattacagatgaggaactcctcagaactgcaggaattgatacctgtgatacggttgtagtggcaacaggggaaaatctagaatcgagtgtgcttgcagttatgcattgtaagagtctaggggtaccaagggttattgccaaggtcaaaagccagacagctaagaaggtgctagaaaaaatcggtgctgactcggtgatttcacctgagtatgaaatggggcagtccctagcgcagaccattctctttcataacaatgtcgatgtttttcagctggataaaaatgtgtctatcgtggagatgaagattccgagtgtttgggcaggtcaaagtctgagccagctggatctacgtggcaaatacaacctcaatgtcctaggattccgtgaacaagaaaattcaccactggacgtccagtttggtcctaatgatctcttgaggtcagatgcctatatcatggcggtcattaacaaccagtatctagatgatttggcagaattaaattcgtaaggagggggatcccctcttttttgatgtccaaaatagcaaatagagatagcaacccttgtattctagtaaaagtccttcaaaagctggactttatggtagaatagaaagaagtgacaagagagaaagaaaaaatcagtcccctaaaggagtagattatgaagttattgtctatcgccatccctagctataatgccgctgcctatcttcattactgtgtggagtcgctagtgattggtggtgagcaagttgagattttgattatcaatgatgggtctcaggaccagactcaggaaatcgctgagcgtttggccagcaagtatcctaacatcgttagagccatctatcaggaaaataaaggccatgggggtgccgtcaatcgtggcttggcggaggcttctgggcgctattttaaagtagttgatagtgatgactgggtggatcctcgtgcctatttaaaaattcttgaaaccttgcaggaactagagagtgaggggcaggaagttgatgcctttgtgactaattttgtatatgaaaaggaaggtcagtctcgtaagaagagtatgagttacgagtcagtcttgcctgtccaacagatttttggctgggaccaggtcggaaatttctcaaaaggccagtatatcatgatgcactcgctgatttaccggacagatttgttgcgagcgagccagttccaactgcctgagcataccttttatgtcgataatctctttgtctttaccccccttcagcaggtcaagaccatgtactatctgcctgtcgatttctatcgttatttgattgggcgtgaggaccagtctgtcaatgagcaagtgatgattaagcgcattgaccagcaactcaaggtcaatcgactcttggtagatcagcttgatttgtcccaagtgagtcatccaaaaatgcgagaatatttgctgaatcatattgaaatcacgacggtgatttccagtgccttgctcaatcgagcaggcacagcagagcatcttgccaaaaaacgggagctatggacctatattcagcaggaaaatccagaggtctttcaggctattcggaagaccatgctcagccgtttgaccaaacattcagtcttgccagctcgcaaactttctaatgtcgtctatcaaatcaccaaatctgtttatggatttaattaatataagtattttataagagggatttaataaaaattttaactttttcttaatcctttttaattttaggagattatactagagtcatcaaataaagaaaaactctaaggagaatcctatgaaattcaatccaaatcaaagatatacacgttggtctattcgccgtcttagtgtcggtgttgcctcagttgttgtagccagtggcttttttgtcctagttggtcagccaagttcggtgcgtgccgatgtagtcaatccaacccctgctcaagttatgccagatgctacttcggtgagtgaaaagagtgacttaccagtagaacttctcaaagaagcagtcgatacagctcttccttcagaacaggtagactcaacacctaaagcaagcttggaagctacaaactctccagaaaaaagcagatgcaggtgctaaagaccaagtagttgcaccaaaagaagaagtacaagcaaaaccagaatctaagaaacaaacagaagatgcggttaaacctgcgacaaatcctgcgcctacagttgctggacaagaccgtgaagcaagtgaagtgcaaccagcaactactccagctgaagtccaaaaaggcgtagctgataatactaaagacacagtggatgttccagcctcttacttggacaaagccaatttcccaggcccattcacagctggtgttaaccaagtcattccatatgaattcttcgctggtgacggtatgttaactcgtcttatcctgaaggattcagacaaggctccatggtcagacaacggttcagctaaaaaccccgctctcccaccagtagaaaacttgggcaaaggcctttacttctacgaagtagacttggcaggtacccaaggtaaatctgataaagagcttctagacctcttgaaacaaaacggcactcaaagctataaagcaactatcaaagtgtacggtgcgaaagacggcaaggcggatttgagcaacctcgtagcgactaaggatttggatgtcaacttgaacggcttaactactccagctgaagtgcaaaaaggcgtggccgacaatactaaagatacggtggatgtcccagctacttacttggacaaagccaacttccctggtccattcacagccggtgttaaccaagttatcccatacgaactattcgctggtgacggtatgttgactcgtttgatcttgaaagcttctgacaaggcaccatggtcagacaacggatcagctaaaaatccagctctcccaccagtagaaaaattgggcaaaggcctttacttctacgaagtggatttggcagggactcaaggaaaatctgataaagagcttcttgaccttttgaaacagaatggcactcaaagttacaaggcaactatcaaagtgtacggtgcaaaagatggtaaggccgatttgagcaatctcgtagcgattaagaatctggatgtcaacttgaacggcttaaccactccagctgaagttcaaaaaggtgtggctgataacaccaaagacacagtagatgttccagctacttacttggacaaagctaacttcccaggcccattcacagccggtgttaaccaagttatcccatatgaattcttcgctggtgatggtatgttgactcgtcttatcttgaaggattcagacaaggccccatggtcagataacggttcagccaaaaatcccgcccttccaccagtagaaaacttaggcaaaggtctttacttctatgaagtagacttggcaggaacccaaggcaaatcagataaagatttgcttgacctcttgaaacaaaatggtactcaaagttataaagctactatcaaagtgtacggtgcgaaagacggcaaggctgatttgagcaatctcgtagcgacaaaagatttggatgtcaatttgaatggcttaaccactccagctgaagttcaaaaaggtgtggctgacaacaccaaagacacagtggatgtcccagctacttacttggacaaagccaacttcccaggcccatttacagctggtgtcaaccaagtcattccatatgaattcttcgctggtgacggtatgttgactcgtcttatcttgaaagcttctgacaaggccccatggtcagacaacggctcagctaaaaatccagctcttccaccagtagaaaaattgggcaaaggcctttacttctacgaagtagatttggctggtacccaaggtaaatctgataaagagcttctagacctcttgaaacaaaatggcactcaaagttacaaggcaactatcaaggtgtacggtgctaaagatggcaaggccgatttgactaaccttgtagcgacaaaagatttggatgtcaacttgaatggcttgaccaccccagctgaagtccaaaaaggcgtggccgacaacactaaagacacagtggatgttccagccacttatttggataaagccaacttcccaggcccattcacagccggcgtcaaccaagtcattccatacgaattcttcgctggtgacggtatgttgactcgtctgattttgaaagcttctgacaaggccccatggtcagacaatggttcagctaaaaatccagctcttccaccagtagaaaaattgggcaaaggtctctatttctatgaagtagacttggccggcactcaaggaaaatctgataaagctcttcttgacctcttgaaacaaaacggcactcaaagctataaagctaccatcaaagtgtacggtgctaaagacggcaaggcagacttgagcaaccttgtagcgacaaaagatttgacagtgaacttgcatggacatcagtctctgattccgatgcagtcaggtttcgtcccatcttctaatggttcagctatgccggctccaatgatgaatagtcatcaagatgcatctaagatgaacgctcaaatgcctagtgccaatcaagatgagatgaaatctaaaatgccagctgctagtcaggataagatgatgcctaacaaagagcaggacaaaaccatgaatgctagccagcctatggcaacaccaagcatgaaacaagatcaagctccagcagcctcaagcaaaatgtctgatgaaggcaagatggtatctaataacaaggtatcaagtccaatgatggctgatcaaatgaaagaccaaaaagacatgcttccatatactggtgaagcccaaacatcaatggctactcttggattctttggattagccttggccggacttctaggtggactcggtttgaaagctaaaaaagaagaaaatgactagtctagctacagactttctatctaggatatgaaaaatccagatatcgtttagaatgttcgtaaagagattaaaatagtgttatactattgtggtatagcactgtttttttcaaaggagagacagatgggaaagacaattttactcgttgacgacgaggtagaaatcacagatattcatcaacgttatctggttcaggcaggatatcaggttttggtggcccatgatggagtagaggccttagaaatcttcaagagaaaaccaattgatttgattattacagatatcatgatgcctcggatggatggttatgatttgattagcgaagttcagtatcaatctccggatcagccttttctctttatcacggctaagaccagtgagcaggacaagatttacggcttgagcttaggggcagatgactttattgccaagccctttagtcctcgtgagctggttttgcgtgtccacaatatcttgcgtcgccttcatcgtggaggtgagacagaagtcgtcagtctcgggaatttacggatgaatcatggtagccatgaggtccaagttggagatgtggcgcttgatttgaccgtcaaatccttcgaacttctatggcttttagccagcaatccagagcgggttttctctaagacagacctctatgaaaaggtctggcaagaagactatgtggatgacaccaataccttgaatgttcatattcatgctcttcgacaggagttggctaaacatgctagttcagaaacacccaccatcaaaaccgtctggggcttgggctacaaaattgagaaagcacgaggtagttaatgaaattaaaaagttatattttagtggggtatgtcatttcaacactcctaacgattatcgtggttttttgggccatccagcgaatgctaattgaagaaagagaaatttatttcctagtgggtatgactctagtggctagttttatcggtgctgggattagtctctttctcctatcgccggtctttacttcattgggcaaactcaaggaacatgccaagagagtagcggacaaggatttccctgcaaatctggaggttcaaggccctgtagaatttcaacaattaggccaagctttcaatgaaatgtcccatgatttgcaggcgacatttgattccttggaagaaagcgaacgagaaaagggcttgatgattgctcaactttcgcatgatatcaagacccccatcacttcgatccaagcgacggtagaagggattttggatggggttatcaaggaaggagaacaggaccattatctagcaaccattgggcgccagactgaaagactcaataaactggttgaggagttgaattttttgaccctaaacacagctagaaatcaggtcgaaacgaccagcaaagacagcatttttctggaccagctcttgattgagtgcatgagtgaatttcagttcttgattgagcaggaagagcgagatgtccatttgcaggtaattcctgagtctgcacggattgagggagattatgccaaactttctcgtatcttggtgaatctggtcaataatgcttttaaatactcagctccaggaaccaagctggaagtggtggccaagctggaaaataaccagctttcaatcagtgtgacggatgagggacaggggattgccccagaggatttggagaatattttcaaacgcctttatcgtgtagaaacttcgcgtaacatgaaaacaggtggtcatggcttaggacttgctattgcgcgtgaattggctcatcaattgggtggagaaatcacagttaccagccagtacggcctcggaagcacctttaccctccttctcaatctctctggcaatgaaaataaagcttaaaacccctttacaaatctagccattcatggtaaaatggattttgtgtgaaatatcagcaggaaagcatgaagctcgtcaacaggtgtcttatgataagtaaccttggctgtttaggcgaagggcatctgcacgaatcagggctttctaagtgactatttccaccgaaatattatttatatcaggagggcattcacatgtcacgttatacaggaccatcttggaaacaagctcgtcgccttggcctttcacttacaggtacaggtaaagaattggcacgtcgtaactacgtaccaggacaacacggaccaaacaaccgttctaaattgtcagaatacggtttgcaattggctgaaaaacaaaaacttcgtttcacttacggtgtaggtgaaaaacaattccgtaacttgttcgtacaagctacaaaaatcaaaggcggaatcctaggtttcaacttcatgcttcttttggaacgccgtttggataacgttgtttaccgtcttggtcttgcgactactcgtcgtcaagctcgtcaattcgtaaaccacggtcacatccttgttgacggaaaacgcgttgatatcccatcataccgcgtaactccaggtcaagtgatttcagttcgtgagaaatcattgaaagttccagctatccttgaagcagtagaagctactcttggacgtccagcattcgtatcattcgacgctgaaaaattggaaggttcattgactcgcttgccagaacgcgacgaaatcaacccagaaatcaacgaagcacttgtcgttgaattctacaacaaaatgctttaattttaagatatatcttacagaaagcctacaacagtgggctttttgctttgtcttaaaatgttgatctctgggtttgtttagagatttgctagtaaggttattggtgtatctaggtctatctattccaagaatgacgcgatattgatgatataatattttagcctcctcagtttaatgaagggaggtgttatgtatgctagagttactttccctttttctagctccgttacttgttaacgtactatctgagcttttcaagctatggataaagagacgtagcacccttttagagggtagcaaaaaaccccatcggtggcacggtggggttttttagttatatatgctagaagcattattttccctttatgctttcattctaacacaacccctccgatatttcaagcttttgttttgatatgtcctcagaggtcattacgcaatcttataacactgaagcctgtggtttgagtccgctttactgaaattagcccacgcgcttctagcctccattctacagcaaagaaatcaactcttttctaggggatttccgccctcatttttgtcttttgtgctaaaatagacttataaattgaaaataaggaatgtttatgaaatcgggtaatggtttttggaaaggctgtctctatttttggggcttcttgttcttattaggcctgttggtccaatatgctcttccgcttgcggcttgtgtcctgctaggctatggtggttatcgcctctataaacgttggcgctatcctcttttgcaggatcgttcgctcgatgatcggattgagcttttaaaagctcggattcgtcaggcggacaaggatattcagcagttagagggagtcttggtagagaaaggctcagattcctataagagtttggctaatcaagtattgatcgaactgagggaaatccatcaggaggcggattgtctcaagtcctatatcgatgctgatgtctacaaccgtattgacaaaaaggttcgtacagtaagggcaaacatcgatgttcagctagaacgtttggatagagaaagtcaggtagatcttgaaaatgcggagccagaggaactagctccagaattgtcccagaccttggctaatattgccattgaccatcaggcaattttagataagattgccacctctgctgagggggataaggaagaattgactgccattcatagtttgaagatggagaaattccaaacgattttagaaggctatttaaagattaaggccaatcctaaaaactataatcgagccgaagaacgtttgcaacaagctaaagcagctatcgaacaatttgaccttgagctggaccaagtcctgagagaactcaatgaaacagatatgcgtgattttgatatcagtctgcgtatcctagaaaaagatcgtaaagaataggttagaaacaaaggagtaaccatgacagaatttaattttgatattgaccagattgccaataatacggtagctaaggtggataaaacaacccaaatcatcgagacaaatactggctcagacaagaccttgaccttccttgaaaagttgagccctgagcagcaagaaggaatcaaggcgcacgtgccccagttagtagaccagtttgtcaccaatcaaaatgctcttttggattttggacaatctgctgtcgaaggtgtgaataatacggtcaatcgtatcttgtcagaacaaaagaaactgcagattccccaagtggatgatctactcaagaacaccaaccgtgagttgcaaggctttgtagtcaaatacaagaacgctgaaattgctgagttagaagagaagccaaactttttgcaacgattgtttaacaagagcaagaataccttacaggaattttactttgactcaaaaacagtggagcaaaagctcgatggtatggctgccgcagtggtcaagcaagaagatgtgctagctcgaaatatcgtctctgctgagatgttgattgaggacaataccaaatccattgaaaatctagtgggagtgatttcctttatcgaagccagccagacagaagctggcaatcgtgctgccgaactaaaggcccaagctgaccaacttgatacaagtacggtagaataccagaccaagtctcaagaattggcccgtatggcagaagtggtcaatacactcgaacaacaacatacagagtatgtcagccgtctctatgtggcctgggcaacaacacctcagatgcgtaatcttgtgaaggtgtcatctgatatgcgccaaaaattgggcatgcttcgtcgtaatacgattccaacaatgaagctttctattgcccaacttggtattttgcaacaatcaatgaaatcaggtgtcgtggcagatgccattgtcaatgccaataatgctgcccttcagatgctagctgaaaccagcaaggaagtgattccgcagatggagagaattgcacaaagcccgacagtcgctgtcgaatctgttaccaaactggctgaaagtctggtcgctcaaaaccaaggtatcgtcgcagcaattgagttgggacgtcagaaacgtgcccaactagaaacaaccatcgtcaagtccgcagaaatgatcaacgattctgtcaaactacgcgatgagaaaatcgttcaagcccttctagaccaaggcaa

SEQ ID NO: 56 - DNA, 24459 bp, Streptococcus mitis NCTC 12261 contig2
attaagacaatacgaggagaaagatgaaagaaaaaggattttgggagggggcgcaggcagccatgccaacggcccttggttatatcagtatcgggctggcctgtgggattattggtgcgccttatgtgacacctgtggagatgggcttgatgagcctctttgtttatgctgggagcgcccagtttgccatgttggccttgattgcggttcaagctcctgtggcagctattgctatgacggtctttttgatcaatttgcgtctctttttgttgagcttgcacgcatcaacctatttccgtcataccagtctctggcaaaatatcggtatgtctagcctcttgacagatgagacttatggtgttttgatgggcgagttagcccatacagacaaggtcaatcctatgtggatgcacggaaacaatctcaacagctatgtggcttggtttgtgggaacagttgtcggaacggctctgggtggcctgctaccaaatccagaaatctttggattagattttgccttggttgggatgttcatcggaatttttgcttcgcaattccagattatgcaaagacggattcctgtccgcaatctgctcattatcctagcagttgttgcggtgtccttctttttactcttaacagtggtgtctcagtcactagctgttctgtttgcgacgctacttggttgtacaatgggggtggtattagatggtcagtaagtatcttttattagcagttattttctctggcttggtgacctggattccccgtatgattcccttcatcttggtcaagtataagggtttgcctgcaatcgttgagcgttttttgaagttcttgcccgtttctattatctttgccttgattctttcaagcgtagtaacaggtaaggttgggagccttcctcaaatcaaatggctggatttcttagcagtctttccaacagcttgggtagcctttcgttatcgcaatctagtcggaacagttctctttggagtggtcttaattgcactcttgcgtttggtcttttaaatcagccataaagaaaacctatcacagagatagatatcatataatggcgtaaatgttttttttctgttaagattataaggtattctattttggaggaaatgaaatgaaaaaaatcgttaaatactcatctcttgctgccctagggcttgttgctgcaggtgtgttagcagcttgctcaggtggtgctaagaaagaaggagaagcagctagcaagaaagaaattatcgttgtaaccaatgctacaccaaaaccattcaactatgaagaaaatggcgaattgactggttacgagattgaagtggttcgcgctatctttaaagactctgacaagtatgatgtcaagtttgagaagacagagtggtcaggtgtctttgcaggacttgatgctgatcgttaccaaatggctgttagcaacatcagctacactaaagaacgtgctgaaaaatacctttatgcagctccaactgctaaaaaccctaacgttcttgtagtgaaaaaagatgactctagcatcaaatcgtttgatgatatcggtggaaaatcaacagaagttgttcaagggacaacatctgctaaacagctagaagactacaacaaacaacactcagataacccaactgtccttaactacgttaaaggggacttccaacaaatcatggtacgtttgagtgatggtcgatttgactacaagatttttgataagatcggtgttgaaacagtgatcaaggatcaaggtttggacaacttgaaagttatcgaacttccaagcgaccagcaaccttacgtttacccacttcttgctaaaggtcaagatgagttgaaaacgtttgtggacaaacgcatccaagaactctacaaagatggaactcttgaaaaattgtctaaacaattcttcggaggcacttatctaccagcagaagctgatattaaataatttcttgaaatcatccattctgagtagatgggtgatttctcagtttttagggatatagttttaaactatatatctgactatctaataacaatttgtgaaatcaaacaaattgtgagatactagtacggtattatttttaaaggagatagaatcatgaaaatcaaaaaatggcttggtgtagcagcccttgctacagtcgcaggtttggctcttgcagcttgcggaaactcagaaaagaaagcagacaatgcaacaactatcaaaattgcaactgttaaccgtagcggttctgaagaaaaacgttgggacaaaatccaagaattggttaaaaaagacggcattactttggaatttacagagttcacagactactcacaaccaaacaaggcaactgctgatggcgaagtagatttgaacgctttccaacactacaacttcttgaacaactggaacaaagaaaacgggaaagaccttgtagcgattgcagatacttacatctctccaatccgcctttactcaggtttgaatggaagtgacaacaagtacactaaagtagaagacatcccagcaaacggagaaatcgctgtaccgaacgatgctacaaacgaaagccgtgcgctttacttgcttcaatcggctggtttgattaaattggatgtttcaggaactgcccttgcaacagttgctaatatcaaagaaaatccaaagaacttgaaaatcactgaattggatgctagccaaacagctcgttcattgtcatcagttgacgctgctgttgtaaacaataccttcgttacagaagcaaaattggactacaagaaagcacttttcaaagaacaagctgatgaaaattcaaaacaatggtacaacatcatcgttgcgaaaaaagattgggaaacatcacctaaggctgatgctatcaagaaagttgttgcagcttaccatacagatgaagtgaaaaaagttatcgaagaaacatcagacggtttggatcaaccagtttggtaataagaaacagggaggtgggagagaaaattccacctcttgcttttgtataaagcatggattgtcaggaagagtagctcatagaaaggtagagagaatatggtttttcctagcgaacaagaacagattgaaaaatttgaaaaggatcatgtggcccagcattattttgaggttttgcgtaccttgatttctaagaaatcggtctttgcccagcaggtcggacttaaggaagtcgcaaattatctgggcgagattttcaaacgtgttggggctgaagtggagattgatgagacttatacggctccctttgtcatggcgcatttcaagagttcgcgcccagatgctaagaccttgattttctataaccactatgacactgttccagcggatggggatcaggtctggacagaggatccttttacgctttcggtccgcaatggcttcatgtatgggcgtggagttgacgatgacaagggccatatcacggctcgtttgagtgctttgagaaaatacatgcagcaccatgatgatttgcctgtcaatatcagttttatcatggagggagcggaggaatcggcttcgacagacctagataagtatctggaaaagtatgcggataaactccgtggggcggatttgttggtctgggaacaagggaccaaaaatgccttggaacagctagaaatttctggtggaaataaggggattgtgacctttgatgccaaggtgaaaagcgctgatgtggatatccattctagttatggtggggttgtggaatcagctccctggtacctccttcaagccttacagtctcttcgtgccacagatggtcgtatcttggttgaaggtttgtacgaagaagtacaagagccaaatgaacgggaattggccttggtggacacttacgcccaacgaaatccaggggaaatcagccagatttatggtttggaattgcctctcttacaagaggaccgtgcagcctttctaaaacgtttctttttcgagccagcccttaatatagaagggattcagtcaggttatcaaggacaaggggttaaaacgattttgccagcagaagctagtgctaagctagaggttcgtttggttcctggtctagaaccgcatgatgttctgggaaaaattcggaaacagctagacaaaaatggctttgataaggtagaattatactataccttgggagagatgagctatcgaagcgatatgagcgcgccagccattctcaatgtaatcgagttggccaagaaattctatccacagggcgtttcagtcttgccgacaacagcggggacagggcctatgcatacggtttttgatgccctagaggtaccaatggtggccttcggtctaggaaatgctaatagtcgagaccacggtggggatgaaaatgtgcgaatcgccgattattacacccatattgaattagtagaggagctgattagaagctatgagtagagatattatcaagttagatcagatcgatgtgacttttcaccaaaagaagagaaccatcacagcggtcaaggatgtgaccattcacatccaagaaggggatatctacggaatcgttggatattctggagcagggaaatcaacccttgtacgggtgattaatctcttgcaaaagccatctgcagggaaaattaccattgatgacgatgtgatttttgatggcaaggtgaccttgacggccgagcagttgcgtcgtaaacgtcaagatattggaatgattttccagcattttaacctgatgagccaaaagacagcagaggagaatgtagcctttgcccttaaacactctggactcagcaaggaagaaaagaaggctaaagtagccaagttgttggacttggttggcttggcagaccgtgctgaaaactacccttcacaactatctggagggcaaaaacagcgtgtagccattgcgcgtgccttggccaatgatccaaaaatcttgatttcagacgagtcaacttctgcccttgaccctaagacaaccaagcagattttggccttgttgcaagatttgaaccaaaaattaggcttgacggttgtcttgattacgcatgaaatgcagattgtcaaagacattgccaatcgtgtggcagtcatgcaggatgggcatttgattgaagagggcagcgtccttgaaatcttctcagatcctaaacagcctttgactcaagactttatctcaacagccacaggaattgatgaagctatggtcaaaattgagaagcaagaaatcgtacaacatttgtctgaaaacagtcttttagtgcaactcaagtatgcaggtgcttcaacagacgagccacttttgaatgaattgtacaagcattatcaagtaacggctaatatcctctatggaaatattgaaatcctcgatggtactcctgttggagaattggttgtggtactgtctggtgaaaaagcagcgttggcaggtgctcaagatgccattcgtcaagcaggcgtacaactaaaagtattgaagggaggacagtaagatggaatcattgattcaaacctatttgccaaatgtctataagatgggctgggctggtcaggcaggttggggaacagccatctacctaacactctatatgacagttctttccttcatcatcggagggttcttggggctagttgtaggtctcttccttgtcttgacagcgccaggtggtgtcttggaaaataaagtcgttttctggattttggataaaatcacttctattttccgtgcggttccatttatcattctcttggcagtcttgtcacccttctctcatctaatcgtaggaacaagcattggtccaaatgcggctatcgtaccgctatcttttgcagtctttgccttctttgctcgtcaggtgcaggttgtcttggctgagctagatggtggtgtcattgaggcggctcaagcgagtggagcgaccttctgggatatcgtaggtgtttacctatccgaaggtctgccagatttgatccgtgtgacgactgtgaccttgatttctcttgttggagaaacagctatggctggtgcggttggagctggtggtatcggtaacgtagccattgcttatggatttaaccgctacaatcacgatgtaactatcttggcaaccattattatcattttgattatctttgcaatccaattcttgggagacttcttgaccaagaaattgagccataaataaaaaagagccgtctggctcttttttagtaatcagattttctgtgccaattttttactcaaggcttgtccaatcaaggcacccactagggctccgatgataatacttgcgataaatagaaggacggttccagggtttggagcaaccatgatacggtcgatatattcttgtgattttcctcttgctagaagggttgccatataggttttgggcgcaatccacataagtaagattgggccagttgagctgaaggcaaaaataataaaagaaagaaagttctttgtttggtccttgtattttccgaggctagctactgcatctgctagcaggccacagataattccaggaaggaaggcaccggcaccgtgtttagttcccaagaaaaagagagcaatgacaaggccgatagtggtaatggctccaaaacgtggaacttttgcgattagaatcatatagacgccaccgccgacaagggcagtaaaagcaggcgcataaaacatgtttccagtttgatcaaagagattgcccaaaaggacaccaatccccatggagaggaagtaaagaactgcaaaaagcagtgtagttaagatagatttcttcatgaattgtctcctgataattttttcacaattctcattgtatcacggtttgaagggattgtaaatgggcactagaagtttttgaaaacgcttgaaatatgatataatagtttcatagttatttttaggaggatatcatggggagatttttagactttgtctttaatcgtttctttttagggatgattgcgacagccttcttttggctattaactttagcaggagggattatccttggtctagcgccggctagtgccaccttgatgagcctatatgcagaacatggttatagctttcgggaatacagtttgaaggaggcgtggtctctttataagcaaaatttcgtctcaagcaacctgattttctatagctttttaggggtgaatctagttttggtctatggcctgtatctcttggtgcaattgcctcatcagactattattcatttgattgcgacctttttgaatgtcctagtagttgccctgatctttttggcttatacagtatctttgaaattacaagtttattttgatttgtcctatcgaaatagtctcaaactatccttgattggcatctttatgagcctagcggctgtggccaaggttctccttgggacagtgctacttgtggcaattggttactatatgcctgccctacttttctttgtaggaattgggatgtggcatttctttatcagtgatatgttggaaccggtctatgaaagtatccatgaaaaattggcgacaaaatagaatgaagcagttttggctacatacgcttctaagaacctacagttcagttatgatgattattattgcgagttttgcaatcttactctcttacgctgactgggattcacgggaaaaggaagctcaaagagtagcccaacgtgtaaccactcgaacagtcgatgaggtggagtattattatcgggagtcagcccaactggcgcaagatttagtagccaatcaagaccggatacaaggggtttataagtactttagcttgtcaacttctgagtatttttattggctattggagcatcaagcagcttcgtcaacttctatttctctgtatgaaaacattgatgatctttatgtccaaaatgactctataacgggtgttgcaatcgtcttgcaggattttaaagaagtttatgtttcaacaagggataaaagaagtggtcatgtcttgcctgctgaggcctttaaaccagaggccaatagttttggcattccagttctggacccagcaacggatcaatctataggagtgatttacatctccttggatccagaagtcttatatcatgccattgacaatacccgaggtcatatcccgatggctgtgactgtgacatcaccatttgatacggagatttttcatattggtgagagggtcaatagggaacatgagaactggtttgtcggttttacctctcatggatatcaggttcaggtggcagttcctaaaaactttgttttacaaggaacagtggctagctctgctttgattgtgggcttgagccttctctttattgtcattctctatctgactttgaggaagacttttgctaattatcaaaagcaggtagtggacctggtggattccatccaagctattgccaaaggacaagaaggtcttcgcattgatacgcttgaaaaggatcaggaattgctcctaatctcggagacgaccaatgatatgttggatcgcttggaaaagaatatccatgatatttatcagttagagcttagtcaaaaagatgccaatatgcgggccttgcaggcgcaaatcaatcctcacttcatgtacaatactctggagttcttgcgtatgtacgcagtcatgcagagtcaagatgagttggcagatatcatttatgagtttagtagtctcttgcgtaacaatatttccgacgaaagagagacccttctcaaacaggaattagaattttgtcgtaaatacagctatctctgcatggttcgctatcccaagtccattgcctatggtttcaagatagacccagagctagagaatatgaaaattcctaagtttaccttgcaaccgctggtagaaaactatttcgcgcatggtgttgaccatagacggacagataatgtgattagtatcaaggcgcttaaacaggatggttttgtggaaattttggtggtcgataatggccgtggtatgtcggttgaaaagctggcaagtattcgagaaaaattaagtcagagacattttgaacaccaagccagttacagtgatcaaaagcaatctatcgggattgtcaatgtccatgagcgttttgtgctctattttggggaccgctatgctattactatagattctgcagagcaagcaggtgttcagtatcgtattacaattcaagatgagtagaaagggagaaaatgtataaagtattattagtagatgatgagtacatggtgacagaaggtctgaaacgtttgattccctttgataagtgggatatggaggtcgtcgcaacagccagtcatgccgatgaagccctagaatatgttcaggaaaatcctgtcgatgtggtcatttccgatgtcaatatgcccgacaaaacagggcttgatatgattcgggagatgaaagaaatcttaccagatgcagcctatatcctactttcgggttatcaggagtttgattatgtaaaaagagcaatgaaccttagtgtggtggactatttggtcaagcctgttgataaggtagagctgggaaatctgctggagaagattgcaggtcagctcggcgagagaggaaagaaaagtcagacccttagtcaagatttagatgaggatggatttgttagttatttaggggataaggagaattggtggataggtctatccaaggaaaagcaaggctccttcaccattccctactatgtcttgggtcaagattggcagatttttatttctgatcaacccctagatggtttagtcgttactccctttgaagctccttatcaagaacactttgaacgctggaagctgaatgctgagaaagccctcttttacggctctgtaaatctacaacagtctgagagtctctttacctattacgaaccgatttatagggttatcattcagggaaatctcaatcaaatcgtagaagagttaaatctcttggagaaggtggttcttgaaaatacgccgcgtgttccgattaccaaacagctttttatccagtttgtcatggatgtcttccacttgtttgaacacctcaaagctgatgatatgacggacattgtcaaaaccattcatgctattcaatccttcgatgaattggttccttatatcaaggaaactctgactcgattctttgggcaatatcgaatgaatgaaaatgtggttagtgtgctagaagttattggtcgtgattatcagaaggaactttccctcaaggatatcagtaaggatctttttatcaatcctgtctatctggggcagttgattaagcgtgaaaccaattcgaccttcgcagagcttttaaataaacaacgcattaaggccgcccaacagctcttgctttcgactagtgacagtatcgaagatatttgttatgctgttggttacagtaatgttggatatttctataaagtattccgaaaattgtgcggaaaatcgccgaaagcctaccgaaaacaggtagaaacgacactataatatttgtatccctttacaaaaagtgctataatatcaataataatatcaggaggttctattatgaaaaagaaaccaatttatctatgggtcttgctaatcttgtctgctcttatttcagctatgtctctgtttggaatgttgagtcccttgcctagcaaagaagtccttcgtgctaaacagtcacatgttgcaggacttagtgcccagcaattagaagacaacatcaattacacctatagagtagcagaatcatctcattctatttttaatatggccttgattgtactatctgctattttagttgtagtagcgattgtcttccttgttcgtaagaatttgcaatatgcaaactatacttatgtcggctatgttttgctagccattattggttcgatttatggctatgttagtttacaagacgctgtgcagttagttcacgatgagaccatgcgtttagggataagtgttatttcacaagccgttagcattttctatatcgtcatcaatgttcttttcttagcccttgtcttctataagatgtggcgtcaacagaaagccttggcggaagaagaggaaaccgaagaacttgcctaagtattgacaaaaaataactatcaagttacaatcttggtagttatttttcgattatacataaaatcatggaggtacatatgaagacaatttctttagtttatattagtctgagtggcaatactgaaagttttgtgacacgcttgaaagactatctcttgtcccagtacgaggggattgaggttcaaaagattcatatcaaggatttggtcaaagaaggccaagatttctatgaaatggaccatccctatgtcgcttttttaccgacctaccttgaaggtgggaatggcgtggataacggagatgttgagatattgacaacgccagtgggagattttatcgcctatggtaataatgctagtaagtgttttggagtggttggttcaggaaatcgtaactttaataaccaatactgcctgacagctaagcaatacagtcaacgttttggtttccctgtattagccgattttgaaatgcgaggtatgctgggagatatcaaacgtgtcgcagctattatcgcagatttgtatgagttggaaagttaagcttaggcttggcttttttattatcttaggcagttgtatcagcattcttactttttatgcttcaagagttgattgatatggtccacttttttagcttctcttttatagagaatagcccaaatgatgaggtagacaatcgcaaactcgataatgagctggagatagaagatccagtgaaaaggaaaccaacctgccagagttgctagtgggataaagccagccagcatgaggaagaaatgggtcatagttgcacggagcaagctccagtcacggctgaataatcgtttaccaaagttgaagagaataccgatggctgcccagataagagtacagtagagcaagaccaaggcaccgtgaacctgatgttgagccatcacttgtccgatcagagattcaggactcagtggtgcgtaggtatttggtgcataaatgagtgaaaagatgatagagaggatgaggccgatgaggacaccagcagctgcgtcgtggaagatttgttttttcatagttctaatttctccttgatggtttttagataacggcgtgaagaataggtgaagctttcgtttttcaagaaaatttctactaggccgtttggggttagcttgagatgagagatggagttgatattgatgatttctgattgggaaatttggataaaattggttggcagaatttcaagaacctgatagagtcgtaaatcaatattgtaggtctggctagccgtttctgcaagaaccttccgattctcgatatagaagcgctgtatcttaccaatcttaactagatagacctgatcatcaatctttcctttgattgtttctttttggtccagattttctgcgaactcgatgactttctggattttatcggtttcttgaggtgcttggacaatcagcttttcctccttgtaagtttcactaatctgtagttctactttcataaatttctctccttgtttttcatacaaaattgtgatcacttattgtacacctttattaaacactattttacgatacctgacaagggactttgtttatgtggagggatttggctcctatgtggtggagcttttctgtcctttctgaaatatggtataatagcactaatcaatttctaggaaaatagatacagaaaggggctgaaagatgtctcatattattgaattgccagaggtgctggcaaaccagatcgcggctggagaggttatcgagcgtccagctagcgttgttaaggagctagtagaaaacgccattgacgcgggctctagtcagattatcattgagattgaggaagctggtctcaagaaaatccaaatcacagataatggtcatggaattgcccacgatgaggtggaattggccttgcgtcgtcatgcgaccagtaagataaaaaatcaggcagatctctttcggattcggacgcttggttttcgtggtgaagccttgccttctatcgcttctgttagtgttttgacccttttgacggcggtggatggtgcaagtcatggaaccaagctcgtcgcgcgtgggggagaagttgaagaagtcatcccagcgactagtcctgtgggaaccaaggtttgtgtggaggacctctttttcaacacgcctgcccgcctcaagtatatgaagagccagcaagcggagttgtctcatatcattgatattgtcaatcgtctgggcttggcccatcctgaaatttcgtttagtttaatcagtgatggcaaggagatgacgcggacagctgggactggtcaattgcgccaagctatcgcaggaatttacggtttggtgagtgccaagaagatgattgaaattgagaattctgacctagatttcgaaatttcaggttttgtgtccttgcctgagttaactcgagccaaccgcaactatatcagtctcttcatcaatggccgttatataaagaacttcctgctcaatcgtgcaattctagatggctatggcagtaagcttatggtaggccgttttccactggctgtcattcacattcatatcgacccttatctagcggatgtcaatgtacacccaaccaagcaagaggtgcggatttccaaggaaaaagaactgatggcgctggtctcagaagctattgcaaacagtctcaaggaacaaaccttgatacctgatgccttggaaaatcttgctaaatcgaccgtgcgcaatcgtcaaaaggtggagcagaccattctcccactcaaagaaaatacgctctactatgagaaaacagagtcgataagatccagtcaagctgaggtggctgattatcaggtagaattaactgaggaagggcaagacttgactttgtttgccaaggaaaccttggatcagctaaccaagccagcaaaactgcattttgcagagagaaagcctgctaactacgaccagctagatcacccagagttagaccttgcgagtcttgataaggcttatgacaagctggagcgagaagaatcatccagcttcccagaattggaatttttcgggcaaatgcacgggacttatctctttgcccaagggcgagatgggctctatatcatagaccagcacgcggctcaggaacgggtcaagtacgaggaataccgtgaaagtattggcaatgttgaccagagccagcagcaactcctagtgccctatatctttgaatttccagcggatgatgctcttcgtctcaaggaaagaatgacacatttggaggaagtgggcgtctttctagcagagtacggagaaaatcaatttatcctgcgtgaacatcctatttggatggcagaggaggaaatcgagtcaggcatctatgagatgtgcgacatgctccttttgaccaaggaagtttctatcaagaaatatcgagcagagttggctattatgatgtcctgcaagcggtctatcaaggccaaccatcgtattgacgaccattcggctagacagctcctctatcagctctctcaatgtgacaatccctataactgtccccacggacgccctgttttggtgcattttaccaagtcggatatggaaaagatgttccgacgtattcaggaaaatcacaccagtctccgtgagttggggaaatattaaactaaaaggaaaactatgtacgaatatttaaaaggaatcattaccaaaatcactgctaaatacattgttcttgaagtcaatggtatcggttatattttgcatgtggccaatccttatgcctattcaggacaggttaatcaggaggctcagatttatgtgcatcaagtcgtgcgtgaggacgctcatctgctttatggatttcgctcagaagacgagaagaagctctttctcagtctgatttcggtttctgggattggtcctgtgtcagctcttgctattatcgctgctgatgacaatgctggcttggttcaagcaatcgaaaccaagaacattacctacttaaccaagtttcctaaaattggcaagaaaacagcccagcagatggtgttggacttggaaggcaaggtagtagttgcaggagatgactttcctgccaaggtcgcagtgcaagctagcgctgaaaaccaagaattggaagaagccatggaagccatgttggctctgggctacaaggcgaccgaactcaagaaaatcaagaaattctttgaaggaacgacagatacagctgagaactatatcaagtcagcccttaaaatgttggtcaaataggagcagagcatgacaaaacgttgttcttgggtcaagatgagcaatcttctctatatcacctatcatgatgaagagtggggccagcccctccatgatgatcaagcattgtttgagttattgtgtatggaaacctatcaggcaggcctgtcttgggaaacggtgctcaacaaacgccaagctttccgtcaagcctttcatggctatcaaattcaagcggtggcagacatgaccgacaccgagttggaagccttgctggagaatccagccatcattcggaatagagccaagatttttgctactcggactaacgcccaagcatttctacgactacaggcagaatatggctcttttgatgcctatctttggtcttttgttgaggggaaaactatcgttaacgatgttcccgattaccgccaagcccctgctaaaacacccttgtctgagaaattagccaaagatctcaaaaaacgaggtttcaagttcacaggcccagtcgctgtcttgtcttttctacaagcagcagggctagttgatgaccatgagaatgattgtgagtggaaaagcggtcactagtgtgtacaggtaactagcatatctgagaatatataaaaagctgagaaatttttcccagctttttatatatactattagattggttagagtgaagtcagaaaagtgattccacctaaaataacaccagctgaatttggaatgatgagtatccaatccttcttaggttcctttgtccatccataaataacccagattaagcaagatattgcagctgataaaggttgaaatggttgagctttatttccctgtaaattagcgataatttgaggtatgtaggcaataaatactataattccaataaaggcaccaatagaacctacgattcgattaattttttgttttgtcatatacacctccttcaaaaggatatcatagaaattagcgaaatgcaataaattcagatacaaattgtaacgaaaaccaatacaaaagcacaaaaatagagaaactatttattttttgttatagtcaaagcgaatgacttgctcttttgcatctacgtgggcgtggactccgaagggaataatggctcttggagttgcgtggccgacattgagattatagacaatcgggatattgctgccaatgatatccaatagtgcctctttatagtcgtcatagaaagtttcatccataggttttccgaccaggagtccactgatgccctcgaatatgccagtgtcttttaaagttcgcaacatctttttgaagtcttctggctcaggcttttcttcgcttgtttctagcaagaggatttttccttcccagtctgacaagtcagggaaaagtttgtatttttgacagagctccgtgctatctgcgtatcgagagttgtcaaagatatcgtagagggattcgaggcaaccaccgaggatttttccctcgaactgggcatttccttgcaacaactcaaaaccggtatttgtatgactgacacgaggtgtccccagagccttgggactgaagtcagtcctttcatcataccaaacgtcactagagcggatttctgagattcttcccgtctcaatcaattctttaaagtagtgaaggctataggttagcatttctttttctaattcacaaatgtctgctaagaaggattgaccataaaaagtcttgattcctagtttatgcaacatgagatggttcatggttgtatccgagaagccaagaaaaattttttgtttgataaccttttgtagttggtcattttcaaaaagataagatagtaggcgataggtatcatctccaccgatggcacataggatcatatcgatgctatcatcagaaaaggcatgaatcaaatcctctgcacgcgcttcaggatggttcttgataaagtctaatccatttagagaatggggcaaaaagataggattgagtcccagatccttgagacgttggacacccaagtccacttcgtgtttgacaaagtcctctccgataatgccactagataaactaacaataccaatagtagaaatcatatcttatcctcctagaattagattgagcctattttatcacaaaagattagatagagctatgtgggatgtcataagaatacttttaaatcaagaaagtagtaaaaaagcaaccgcatctgcagttgcttttatgattcttcttaatagcgtgttggtcctgcacttgcgctgcggatattcaagcgtttcttgagatagaagcgaagggctaggagggctgctccgataatagccagtggcaatggagcaagtactgggttaaggctagctggtaggaagcttgttgcaaagaagacaagcaaccaaaggaacatagaagctaggataaccagtacagatttccagaaaggtggacgttggctgcggtccatatctggtccatagtattggtaaacaaagtagtacatcaagtagaaggcaaatccaccaacaagtccaactagcaggagagtgacaagtccatagccgaaagcctgatctgctgcaaagaaagttgtgagggcactgacgagggcaaagaggctagtgatgaaaagggctgagtccataatcatgagttttggatcatcattttcttttggatgctctttttcatattgttccttgacagtgaaactatgagcccagtgggtcggtgcgccatagagggaacgagcagtcgtacccttggcttgctcttcaaggattttgggaatgacttcctcaaaaatagccttgatttcagcgtctgttttcccatctttgatgaattgttgggtagcgatgtggacaaactcttggtttttcttagttaatttttgtagatcaatctgagacataggaactcctcttagaaccattttttatggatgagatagagagtgagcgagacactcatagcaaaggcgataaagacgattaaccagaaggcatttggctcgccgtttagggggatttcattatccttaaagttcatcccgtaggcagaaaagaccatggttgggatggacatgacgatggtcacaagggccaaggttttcataatgttgttctggttgttggaaatgatagaggcaaaggtctctgtcatagagtgcaagacatttccataaatgtctgccatttcgatggcctgttgggtttcaatcagggtgtcttcaagcaggtcttcgtcttcaaggtatttcttgatattgctggttgagctggtcaatttcttaatcacacgctcatttgttttgagggaagccttgaaatagacgatggttttttccaattccatgagctcaatcaattcttcattacgagttgattgatgcagttgactttcgatttgttcactcttacggtcaatcgaacgaagggctgttaggtaaagctctgcattgcgatagagaatctgaaagataaaacgtgaacgcatgaaggtgtagaaattacgcaatcgacggttgataaagacatcgaggaccggtaatggttccaaacaagtagtgatgatggtttcctctgtgatgataataccaagcgggatggttacgtagtaggtgcgattatttctttcttctgtgaccggcacgtcaacgataatcagggtgtactcgtcttcaatcgtaatacgagacatttcttccgcatcgagcggtgctcgaaggtcggcaatatcgatatcgaaggcgttggcgatttcgagtgattcattttgagttggattgacgagattgatccaagtacccggttcaagtgtatcgatctctttaaattcagttgttgtagagagaaaaacttgtttcatatcccttatcctttctcatttttcagattttttcacaccgtactattatactacaaattaagtcttttgggtaatagaatctcactttttttggtataatggtaagcaataatggactagaaagaacaaaaatgcaagataaaattgtcattcatggggcgcgtgcccataatttaaaaaatattgatgtggagattccgcgagacaagttggttgttgtgaccggtttgtcaggttcagggaaatccagtctggcctttgataccctctatgcggaggggcaacgtcgctatgtggagagtttgtcagcctatgctcgtcagttcttggggaatatggagaagcctgatgtagatgctattgatggtctcagcccagctatttctatcgaccagaaaacgactagtaaaaaccctcgctcgacggtgggaacaacgactgaaatcaatgactatctgcgtctcctctacgcacgtgtggggacgccttactgtatcaacgggcatggagctatcaaggcctcttcagtggagcaaatcgtggataaggttttagaattgcctgaacgccagcgcttgcagatcttggcccctgtcatccgcaagaaaaaaggccaacataagagtgttatcgagaaggttcagaaagatgggtatgtccgtgtccgtgtggatggggaagtctatgatgtgaccgaagtgccagagttatctaagagcaagcaacacaatattgatgtcgtggttgatcgtattgttatcaaggagggcattcgtagtcgtctctttgattctattgaggctgcccttcgtatcgcagaaggctatgtcattatcgacactatggacgactctgagttgctcttctctgagcattatgcctgtccagtttgtggctttactgttccagagttagagccgcgtctcttctccttcaatgctccttttggttcttgtagtgagtgtgatggcttgggcatcaagctggaggtggatactgatttggtagtgccagatgccagcaaaaccttacgtgagggagccttggctccgtggaatcctatctcatccaactactatccaaacatgctagagcaggctatgacagcctttggagtggatatggataagccttttgaggacttgtcagaagaagataagaacttgattctctacggctcagatggtaaggaattccatttccactatgagaatgaatttggtggcgtgcgcgatatcgatattccttttgagggagttgttaataatatcaaacgtcgctaccatgaaactaatagtgactacactcgcacccagatgcgcctttacatgaatgagctgacctgcggaacctgtcatggttaccgtctcaatgaccaggccttgtctgtccgtgttggtggtgcgcaaggaccacatatcggagaaatttcagacctgtctatcgcagaccacttggaattagtcagtcagttgactctttctgaaaatgaagccatcattgctcggcccattctcaaggaaatcaaggaccgtttgactttccttaataacgtgggtcttaactatctgactctgtctcgttcagcaggaactctttcaggtggggaaagtcagcgtattcgcttggcgacccagattggttctaacctatcaggtgttctttatattctagacgagccgtcaatcggtcttcaccagagggataatgaccgtctgattgccagtctcaaaaagatgcgtgacttgggcaatactcttatcgtggtggaacatgacgaagataccatgcgtgaggctgattatctgattgacgttggtcctggtgcgggtgtttttggtggggagattgttgcggcaggtacgcccaaacaggtagctcgtaacagtaagtctatcacaggccagtacttgtcaggcaaacgtgccattccagtaccagaagaacgccgtgttggtaatggtcgttttatcgaggtgacgggagcgcgtgagaacaacctgcaaaatgtcacagctcgcttcccactaggaaaattcatcgcagtgacaggggtgtcgggctcagggaaatcgaccctaatcaatagcattctcaaaaaagctattgcccagaagctcaaccgcaattcagacaaacctggtaagtttaaaacgattacagggattgagcatgtagaccgcttgattgatattgatcagagccctatcggacgaacgccgaggtctaaccctgctacctatacgggagtttttgacgatatacgtgacctctttgcccagacaaatgaggctaagattcgtggttacaaaaagggacgtttcagtttcaatgtcaagggtggtcgttgtgaagcctgctcaggtgacgggattatcaagattgagatgcacttcttgccagatgtttacgtggcttgtgaagtctgccacgggactcgctacaatagtgaaaccctagaagttcattacaaggaaaagaatatctcgcaggtcttggacatgactgtcaatgatgcggtggaatttttccaacacattccgaaaattcaacgcaaacttcagactatcaaggatgtagggctaggctatgtgacgctaggtcaaccagctaccactctttctgggggagaagcccagcgtatgaagctggctagcgaactccacaaacgctcgacaggcaagtcattctatattctggatgaaccgacgacaggactccatacagaggatatcgctcgcttgctcaaggttttagctcgctttgttgacgatggcaatacagtccttgttatcgagcacaatttagacgttatcaagacagcagaccatattattgacttgggacctgagggcggtgtcggtggtggaaccatcatcgcaacaggaactccagaagaagtagcggccaatgaagccagctacacaggacagtatttgaaaggaaagttacatcatgaataaacgtgtacaagcatttctagctaaaatgcaagaaaaagaactagatggcatcatcatcaataaccttaaaaacgtctattaccttactggtttttggggctcaaacggaacagtctttatcagccgtgaccgtcaggtcttggtgacagactctcgctatatcattgcagctaagcaagaaaccagtggctttgagattgtggcagaccgtgatgaattggctgtcattgcaggaattgtcaaggacatgggcttgtctcgtatcggttttgaagatgagatttcagtgtcttattatcaccgtatgcaggcaacctttgaaggaattgacttgcttccacaaactcagtttgtcgaaggtcttcgaatgattaaggacgaggcagagattgcagctattcgcaaggcttgttctatctcagaccaagctttccgcgatgcgcttgactttatcaaaccaggaaagactgagattgagattgccaacttccttgacttccgtatgcgtgagttgggagcatctggcttgtcttttgatacgattctagctagtggtatcaactcttccaaacctcatgctcatcctatgcacaaaccagtggagctgggagaagccattactatggacttcggttgcctttatgaccactatgtcagtgatatgacacggactatctatctggggcatgtcagcgacgagcaggcggagatttacaatacggttttgaaagccaaccaagccttgattgaccaggctaaggcaggattaggtttccgagactttgacaaaatccctcgtgatattattatcgaggcgggctatggcgactactttacccacggtattggacacggtattgggctggatattcatgaggaaccttactttagccaaacttctacagaaattattaaggcaggtatggccttaaccgatgaaccaggtatctatatagaaggcaaatacggtgttcgtatcgaggatgatatcttgattacagagaccggttgtgaattgttgaccctagctccaaaagagttgatagttatctaagagttaaacaactcaaatgattgacttttaaattttaaaggtttatactgaaaaacgaaaacggtaggtgaggctaccatagggatacggatgactaccgcaaagcagtggagacactactcgttggtcaacagtcctggtcgcgaaggccaagactaagctcattacattgccctatggagttaaagcttgaacgaaaaacagataattagttttttaatcctgccattttatggtgggattttctactgtttaaatcaaagaaaggagatagacgatgcaaattgacgatcatccggaaccgcacatacacagccaatcgctgatttgtgtcattctgcccttataaagtgattggtctctgtgtatgaaacacatcattcatacagataggagaaaccaatgaaaactacaaaagaaagattagcaacagctattcatacatctttaaacgaaactctatctttttataagacaagtctaacaggcttgactgaggagcaggtggagaaaaatcgtgacctatatggcgaaaataccatcacaaagggtcaagaagaaagtatcctcaaaaagatttacgaatccattatcaatccttttacgatcatcttactggtcatcgccgtgatttccttggtgaccaatgtctggttggcaaaaccaggtcaagaagatccgacaacttccattatcatcgttgtcctagtcctcatttctggtggcatacgctttgtccaagaactccgtagtgataaggctgcgactaatctatcaaaaatgattgtcaacacagcgactgtcattcgtcaaggagaaatccaagaagtacctatcgatgatttggtagtgggtgacgtggttaaattaagcgctggagacatgattccagcagatcttcttttatttgagtcgcgcgatttctttgtacaacagtcgggcttgacaggtgaaagtgaatcggttgaaaaattggccttgaccaaggcaacagttcaacaatctgatagtctgctagaagcagaagcgctcgcctttatgggaaccaatgtcttatctggtagtgccaaggccgtggttttagcagttggtgatgataccatgatgggagccattgagcagactttgaacacctatgaagagcctacttcgtttgagcgggagatgaatagtatttcgtggctcttgattcgtttgatgctggtcatggtgcccatcgttttcttgtccaatggtttaacagatggtgactggctggaagctggcgtatttgctttga

SEQ ID NO: 57 - DNA, 81409 bp, Streptococcus mitis NCTC 12261 contig3
caaacctcatgctcatcctatgcacaacccagtggagctggagaagccattactatgactttcggttgcctttatgaccactatgtcagtgatatgacacggactatctatctggggcatgtcagcgacgagcaggcggagatttacaatacggtttggaaagccaaccaaagccattactatggacttcggttgcctttatgaccactatgtcagtgatatgacacggactatctatctggggcatgtcagcgacgagcaggcggagatttacaatacggttttgaaagccaaccaagccttgattgaccaggctaaggcaggattaggtttccgagactttgacaaaatccctcgtgatattattatcgaggcgggctatggcgactactttacccacggtattggacacggtattgggctggatattcatgaggaaccttactttagccaaacttctacagaaattattaaggcaggtatggccttaaccgatgaaccaggtatctatatagaaggcaaatacggtgttcgtatcgaggatgatatcttgattacagagaccggttgtgaattgttgaccctagctccaaaagagttgatagttatctaagagttaaacaactcaaatgattgacttttaaattttaaaggtttatactgaaaaacgaaaacggtaggtgaggctaccatagggatacggatgactaccgcaaagcagtggagacactactcgttggtcaacagtcctggtcgcgaaggccaagactaagctcattacattgccctatggagttaaagcttgaacgaaaaacagataattagttttttaatcctgccattttatggtgggattttctactgtttaaatcaaagaaaggagatagacgatgcaaattgacgatcatccggaaccgcacatacacagccaatcgctgatttgtgtcattctgcccttataaagtgattggtctctgtgtatgaaacacatcattcatacagataggagaaaccaatgaaaactacaaaagaaagattagcaacagctattcatacatctttaaacgaaactctatctttttataagacaagtctaacaggcttgactgaggagcaggtggagaaaaatcgtgacctatatggcgaaaataccatcacaaagggtcaagaagaaagtatcctcaaaaagatttacgaatccattatcaatccttttacgatcatcttactggtcatcgccgtgatttccttggtgaccaatgtctggttggcaaaaccaggtcaagaagatccgacaacttccattatcatcgttgtcctagtcctcatttctggtggcatacgctttgtccaagaactccgtagtgataaggctgcgactaatctatcaaaaatgattgtcaacacagcgactgtcattcgtcaaggagaaatccaagaagtacctatcgatgatttggtagtgggtgacgtggttaaattaagcgctggagacatgattccagcagatcttcttttatttgagtcgcgcgatttctttgtacaacagtcgggcttgacaggtgaaagtgaatcggttgaaaaattggccttgaccaaggcaacagttcaacaatctgatagtctgctagaagcagaagcgctcgcctttatgggaaccaatgtcttatctggtagtgccaaggccgtggttttagcagttggtgatgataccatgatgggagccattgagcagactttgaacacctatgaagagcctacttcgtttgagcgggagatgaatagtatttcgtggctcttgattcgtttgatgctggtcatggtgcccatcgttttcttgtccaatggtttaacagatggtgactggctggaagctggcgtatttgctttgagtgttggtgtcggattaacacctgagatgcttcctatgattatcacggccagtctagcaaaaggctccatcattatggccaaggaaaaagtggttatcaagaaactcaatgccatacaggacttaggggcgattgatattttgtgtacagataagacaggaactctaacccaagacgaaattgtccttgaatatcccttggacatccacggacgcttggatttgaccgtcttgagacgagcttatctcaattcttattttcaaacgggcttgaaaaatttgatggacagagctatcatcaaacggactgaaaaggaagccaaagaacacaccctcttacaaaatctggatcaaacttttcaaaaaatagatgagcttccctttgattttgaacgtagacggatgagtgttatcgttaaggatgaacacgaagttgttagtttggtaaccaagggtgccctagaggaaatgttgacgatttccagtcatgcggaataccaaggagtgattactcccttgacagatgctattagagaagagattttagaggaagtccgacaactaaatcaacaaggtttacgtgtcttgggagtggcctataagtcaggtttgagggaaggtcatgcctatacagttgatgatgaaggggatatgattctaactggttatttagccttcctagatcctcctaaaccatctgcagcaccagcaattaaggctctgttagaacatggggttcaaacaaagattttgacgggagacaacgagaaagttacccaagcagtctgtgaaaaggttggtttagatatcaatcagatgctgttaggatctgaaattgatcagatgagtaatcaagaattggctcaagccgtggaggaggtaacagtctttgccaaactttctcctgaccaaaaagcacgaattattttgcaatttaaggctaatggtcatgctgttggctatatgggagatgggatcaatgatgctccttctatgaaagttgcagatgtggggatttctgttgatacagcagtagatattgccaaagaaacagcggatgttatcctacttgataaggatctcatggtgcttgaaaaaggacttgttgaagggcgtaaggtctatgccaatatgaccaaatatatcaaaatgacagtgagttctaattttggaaatatcttatccctattagtctctggaatatttttaccatttttaccaatggcgccagtccatttgattatcctaaatctagtctatgatttatcttgtatcgccttgccttttgacaaggtggacaaagattttttgagaaatccgcatacctgggaagctaggtccatcacacgtttcatgatttggatgggacctatctcttctgcctttgatattttgacctttattttgctttattttatcattgtacccatgacaacaggtcaagcttatgttcatggggcagagtctgccgtagaatttattgtcttgtttcagacaggttggtttatcgagtccatgtggtcacagaccatggttatccatatgctgcgttcagccaaaattccctttttacaaagtcgtccagcttggctagtccttgtgacaaccttattggctgcagcctttgtgaccttccttccctacagtccactcgcaatcctacttcatctaactccattaaaaccgatttatttcatctttttacttttcatcattattttgtatatgattagcgtgacaattgtgaaaaaaatctatatcaagaaatatcaagaatggctgtaaatttcattttgtcaagaaaaaagtacgaaaatgacgaaaaaagttaaaaaatttaaaaataggtcgcaagtcggatgttttttatggtataatagactaaactgatagtaacatgtagcgaaaggggtaggtacatgattaaaatttatacagtctcaagttgtactagctgtaaaaaagcaaaaacctggctcaatgcccaccagttaagttataaagaacaaaatcttggtaaagaaggaattacgagagaagaattactggatattctaaccaaaacagataacggaatagccagcatcgtttcatctaaaaatcgctatgccaaagcccttggagtggatattgaagatttgagtgtcaatgaagtcctcaatctgattatggaaacaccgagaattttaaagagcccaattcttgtggatgaaaaacgcctacaagttggctataaggaagatgatattcgtgccttcctaccacgctctgtccgtaatgtagaaaatgcagaagcacgtttgcgtgcagctctataaacatcaaggctgggagcaactcccagtcttattttaatttcaaaaagaaagaagaaagaaatgaaaaaaatagttcttgttagtctagctttcctttttgtcctagttggttgtggacagaaaaaagaaactggaacagctacaaaaacagaaaaggatacgcttcagtcggcgttgccagttattgaaaatgccgagaagaatacagttgtgaccaagactttggtcttgcccaagtcagatgatggcagccagcaaacccaaaccattacttacaaagataagacttttttgagcttaacgattcaacaaaagcgtccagtctctgatgaattgaagacctatattgaccaacatggagtggaagaaactcaaaaagctcttctcgaggcggaggagaaggatgaggctatcatagaagctcgtaaattagcaggatttaagcttgaaaccaaactattgagcgcaacagaacttcaaacaaccactagttttgattttcaagttctggatgtcaagaaggcttctcagttagaatatttgaagaacattggtttagaaaatctcttgaagaatgaaccaagtaaatatatttcagacagattggcaaatggcgcgacagaacagtagaaaatccaaataaatagactgcctgaattgtagaacgtaaggaattatgctataatggtactattctaaggaaagagggtgttagaatgggatttactgaagaaacagtacgttttaaattggacgattccaataaaaaagaaattagcgaaactctgactgatgtttatgcttcgttgaacgataagggttataacccgattaaccaaatcgtaggttacgtattgagtggagaccctgcctacgttcctcgttataataatgcacgaaatcaaatccgtaagtatgagcgcgatgaaatcgttgaagaattggtccgctactaccttaaaggacaaggagtcgatctataacctatgagaattatgggattggacgtcggttcaaaaacggtaggggtggccattagcgatccgcttggttttacagctcaaggacttgaaatcatccaaatcaatgaggagcaaggtcaatttggttttgaccgcgttaaggagttggttgatacttacaaggtggaacgatttgtagtgggcttgcctaaaaacatgaacaatacaagcggaccgcgcgtggaagctagtcaagcctacggagcaaagctagaagagctttttggtttaccagtagactatcaagatgaacgcttgacaacagttgccgcagagcgcatgttgattgaacaagcagatattagtcgcaataagcgcaaaaaagtcattgataagttagcagctcagctgattttacaaaactatttagatagaaaattttaatataaaggagaggctatgtcacacgatcataaccacgaccacgaagaacgtgaactaatcacactagtagatgaacaaggaaatgaaaccttgtttgaaatccttttgaccattgacggaaaagaagaatttggtaaaaactatgttcttctagtaccagttaacgcagaagaagacgaagacggacaagttgaaatccaagcttactcattcatcgaaaacgaagatggaacagaaggcgaattgcaaccaatcccagaagactcagaagacgaatggaacatgattgaagaagtcttcaacagctttatggaggagtaaacacgtccagtggacgtgtttagcactgcgctagaaattagaaacgcaggcacatccagtggatgttttaccccaagctaatattcatagtagctagttattagctaaccaggtaagaggtcgggacgaaaatcctggcctcgtttttgttagttatgagactttattgaggcagttgattgaacctgtaattaaggagatgtatatgtttgaagtagaagaatggcttcatagtcggattggtttgaattttcgatcaggtttgggccgaatgcaacaagcggtggatttgttggggaatcccgagaagtcttatcctattatccacgtaacaggaactaatggaaaaggatctaccattgcttttatgagggagttatttatggggcatgacaaaaaagttgcgacctttacttcccctcatatcgtctctatcaatgatcgaatctgcattaacgggcaaccaatagctgatgcagacttcattcgtttggctaatcaggtcaaggagatggagaaaatgcttctgcaaacccatgatcagttgtccttttttgaattgctgaccttgattgcttttctttattttagagagcaagaggtggatttagttctattagaagtgggaattggtggcttacttgacacaaccaatgtggtaattggagagattgctgtcatcacctccatcggacttgaccatcaggagactctgggtgacaatatagcagcaattgcagagcagaaagctggtatttttaaggctggtaaaaaggcagtgattgctaagttgccttcagaagctaggcttgtttgtcagaaaaaagcagactctttagctgttgacctttatcaggcaggccaagatttttcaatgctgaatgggaatttttcaagctctttggctaacctttcacagttgaaaataggtttggaaggagcttatcagcaggaaaatgcggccttggcgctacaaacgtttcttctctttatgagggaaggaaaggaagttgttgatgagcaggttgtaagacaggctttggagaagacccattgggctgggcgtttggagcgtatttgccctcagatttacttggacggtgctcataacctccctgccttgactcgcttggttgaatttattaaagaaaaagagcaggaaggatatcggcctcaaatcctatttggagccttgaaacggaaggattatcaagggatgttgggttacttgactgagaatttgcctcaggtggaactcaaggtgacaggctttgactatcaaggttctttggatgaaacagatgtaacaggttacgatatagttccttcttaccgagaatttattagcaattttgaagcaagagtagatgtccaggatttgttgttcgttacaggttctctctattttatctcagaggtacggggctatctactggggcatgagcagataaattgacctccttttttgaacttgttatactaggaaaactactagttagaaggaaaaacttctgtaaattggtatcagaaaggaaattcatcatgaaattaaaaagattcacactttctcttgcttctctagcaagtcttagtctcttagtagcttgttcacaaagagctcaacaagttcaacaatcagcaactcaaccccaaacacaacaaactcaacaatcacaagctgcttcatcttctacagaaaatacaaatcaggcagcagcaaattcttcacaaaatgtgcccgaggctcaaccaaccaatattgatggaacttataccggtcaggacgaaggagaccgtatcactttagtggtaactggaacaactggtacatggacacaggtagaaactgacggagatcaagaaatcaagcaggttagcttcgatgctgccaatcaacgcatgattattggggatgatgccaagatttatacaattaatggaaatcagatgattatcgacgatatggatagagaagcgtctgatcgcattgttttatcaaaatagactagaaggagactggttttgtcagtctcttttgtttttactcagaaaaatgattataaatacttgccttctaccgaatacctgcgttatactagtattaattacctgtttttagcattcatactcttcgaaaatctcttcaaaccacgtcagcttccatctgcaacctcaaaacagtgttttgagcaacctgcgactagcttcctagtttgctctttgcttttcattgagtatcaaaatatcaaggaggggatatgaaatatagaaaacttcaattattgatgtccaagtatggctttagtctttcgattatgttacttgaactttgtcttgtttttggtctctttctctatttagggcgcatggcccctattctatgggtaattgtcttaatttttatgagtatggcgactattgtcgcaattgtcaatcgctcaatggcacctgaaagtaaagtaatgtggttagtggtaacttttgttcctgtcattggccccttgctctatctaatgtttggtgaaaggcgattgtccaaaaaagaaatcaagcagttggacaaacttggttctatgcattttcgggaggataacagtaaagctctccgccagaaattgaaggaagaggataaggctgcttacggagttatcaaatctttgttaagtatggatagtaacgccgatgtctatgatcgaacagactcacaattcttttcttcgggtgaaagcatgtggcaatatatgttggaagacctcaagaaagctgagaaatttatctttctagagtactatattgtcgaagaaggtctgatgtggaatagcatactagatatactagagcaaaaggcagctcagggtgtagagatcaagatgctctatgatgatatcggctgtatggcgactttacctggagactatactgttcagcttcgtagtcgaggaattgaagcacataagtttaacaaggtgattcctcgtttgacggtggcttacaacaatcgggaccatcgtaaaatccttgtcatagatggtcaggtagcttatacaggagggattaacttagccgatgagtacatcaatcatgtagaacgttttggctattggaaggatagtggggttcgcttagatggccctggtgtcaaggctctcacccgtctctttttgatgacttggtatatcaatcgtggggaaatcagcgattttgaccagtatcacttggaaaatcagccttgttctggccaagggctctgcattccttacggtagtggacccaagcctatcttccgtacccaggtagggaaaaaagtttatcaaagtttgattaatcaggctactgattcagtctatatcacaacaccctatttgattattgactatgatttaactgagagtattaaaaatgcagccatgaggggtgttgatgtccgcatcgtgactcctttcattccggataaaaaattaatccagctcataacaagaggagcctatccggatcttttgtcagcaggagtcaggatttttgagtatagtccaggctttatccacagtaaacaaatcctagtggacaaggactttgctgcagttggaaccattaatctagattatagaagtttgcttcatcactatgaagatgcagttttgctatataaaacggcatcaatcacagagattcaaaaagattttgaggagattttttcagtatcgcaagaaattttccctcatacgataaaaaatagctggtatcaaaaattgattaaggaaattgcccagttattcgcccctatcttataagaaatctaggacttaggacacaaaccagtcctatttttcttgccttttacgaataagaagatgtaggaggaacgatgctgactcagaaggaattgaactatatcacgacatttaaacagacgcatttacaccgatttcgggaaattgaaacctttgtgaaactatgcaaaaaatcgctcaaacagccatcgcaagctgacaattttaggtctttttgatatactaagacagataaattgaataggagaaacgatatggctgtatatggcagaatcgaagaagtatccgaaatgatacagagtgatggaatagaaaatagactggataggaaccttgaatctcatgtagaaaaagaagaacaggtagctttcccgtttttcagactcatcattggaagtacgattgcaacggttttttctgtggtgatacctttacttttagatatggtaagtccctctcaggcgcaggatttgtatatagggtgggctttacatcagggaggacagctctacagtagctattatgctagtcacggtcttatttattacttgctactttacatcacccaaggaggcattctttttgccttggtagaatggctagccctcttaggaggaggttatttcctcttttcttcaactgactatctgacgggacaaagggaacaagccaagcaactcctaaccatattttatattttggtatccggtctcggttttggaggaggatatgctacgattttagctctgccattcctgtttgcaggattttcgttcatagcagcttatctatcaaatcctaaccatgacaaggggtttctacgtctgggaattttcttggctctatcatttttcatagagcctcttacaagtcttctctttattgcagtagtaacgattggtttatttgtctttaatgttgggcatggccgccttgctcatggagtttatcagttttttgcagcagcacttggcttttctctcatcttttacccagtaggatattatgttcttgcttcaggtggttttggagaagctctaggaagtcttttatatccgattgattcccttcaggtctttgcgaatcctcaactaatggataatgttgtattctatggtttgttgacctttggtttaggagctctcttccttgtttttctaggattgttccaatcaaaggcatcaagattatatgttatttcagtaccagctagttttgctttcttatttatactagccttgttgcttttttctcaagaacctcttcacggttcgcgtttgattctaatcattccatttttactgcttcttttgatgaccagtattcgtgggaagcattcagctaggggagttcgtcgtcggagaagagaagaagttcctactctatggaaaaaattcatgaagggaaatctctacctaccgattctagtggtggtttatctgattgctattccttttgtggctcgttttgtcttgcatccagcttcttatagagaacaacatcaagtggtagatagagtcaaacaagagacgagtgatggtgaccaaatctatatttgggattcacatgttcaaatgtataaagaaagccagcgtttggctggatccatgttcccatcacctcttctttacacgagtacagaagagaataaaactagtttaatcaatgacttgaaagaaaacaaacctaaggtgattgtggtaaacgacaaggtggctctctggtctgaggcggagacactcttaaaagaaaattaccaacaagtaaagactgattactcagagtttaaagtctataaaatcaaatagccaaatcaatatcttgtgtatttttaaaaattttaggatttttaacacaagatattgatttttctttttagagtggtataatactttttagaaagaacattttagaaaagagcatgcatatgattgcactagaagaaaaaattacaattttgccaactctcttcgtcgagaaacgagatgggagacgtgttgtatttgatgtggacaagattgacaaggctctccacaaggcggctgacaaggttatggatgtgacacccttggttgaaaagcgcctaaatgctctgaccgagcgaattgtcacagaaattcatagtcgttttccgcagggggttaagatttacgaaattcaaaatatcgtagaacatgaactccttgaagccaaagaatatgcgctagctgaggagtatattacttatcggacacaaagggattttgagcgttcaaaagcgacagatatcaactttagcatccataaacttctcaacaaagaccaggccgttgtcaatgaaaatgctaataaagacagcgatgtctttaatacccagcgtgatttgacggcggggattgttgggaaatcaatcggactgcaaatgctccctaagcacgtagccaatgcccaccaaaagggggatatccactatcatgatttggattatagcccctacacacctatgactaactgctgtttgattgattttaaaggtatgttggagaatggctttaagattggaaatgcagaggtagaaagtcccaagtctatccagactgcgacagctcagatttctcaaattatcgccaacgttgcttctagccagtacggtggctgttcagctgaccgtatcgatgaagttttggcgccttatgcagagaagaattaccaaaaacacctcaaggatgcggaagaatgggtcttacctgacaaacgggaagattacgcttggaagaaaacccaaaaagatatctatgatgccatgcaatctctcgagtatgaaatcaatactctcttcacttcaaatgggcaaacaccttttacttcactaggttttggtctgggaaccaatcgttttgagcgtgaaattcaaaaagctatcttgaacatccgaatcaagggacttggttcagaacaccgcacagctatcttccctaaacttatcttcacgcttaaaagaggactcaacttagaagaagggactcccaactacgacattaagcagttggctcttgagtgtgcaaccaagcggatgtacccagatgtcttgtcttatgataagattatcgaattgacaggttccttcaaggttccgatgggatgtcgttcattccttcaaggatggaaggatgaaaatggagttgaagttaactctggccgtatgaatctaggggtggtgacggtcaatcttcctcgtattgcccttgagtctgaaggtgatatgaataagttctgggaaatctttaacgagcggatgaacattgcagaagatgctctagtttatcgtgtcgaacggaccaaggaagcaacaccagaaaatgctcctatcctttatcaatacggtgcttttggtcatcgtctaggtaaagaagaaagcgttgaccagctctttaagaatcgtcgtgcgacagtttcactaggctatatcggtttgtacgaagtagcgactgttttctttggtaacagctgggaaagtaatccagatgctaaggaattcacgctggatatcattcgtgatatgaaacgccgtgtagaagagtggtctgaccaatatggctatcatttctctatctactcaacaccatctgaaagtttgacagatcgtttctgccgactagatacagagaagtttggttctattcctgatattacagataaggaatactacaccaactctttccactacgatgttcgtaaaaatccaacaccgtttgaaaaattggattttgagaaagtctatccagaagcaggtgcgtcgggtggtttcatccattattgtgagtatccagtccttcagcaaaatccaaaggccttggaagctgtctgggactatgcctatgaccgtgtgggctatcttgggaccaatacaccaatagaccgttgctacaagtgtgactttgaaggggattttgaaccaactgagaggggttttgcttgtcctaactgtggcaatagcgaccctaaaacagtagatgttgttaaacgaacttgtggctatttaggtaatcctcaagcgagacctatggtcaatggccgtcacaaggaaatcgcagcgcgtgtcaaacatatgaatggttcaacgattaaaatagctggccatcaagtaaccaattagaaagaaatgaaatgggaaaatatcaattagacgataaggggcgtgcacaagtgacccgttatcacgagaaacactctaaaggtggagctggtaaaaaagaacgcttgctcaacctcagagaacaatttttaaacaagaacaagaaaaaataaaagtgagagtcaactctcgcttttctcatagtgggaggtaaggatggaattacgcagaccaagattagcagataaagaaacagttttagagatgatgacagagtttgaaaagagccaatcagcccatgatggaggattttgggatacagagaactttgtgtatgaagaatggttggaaacaaataagcaaaaagaaatgggaataaacttgcctgaaaatcgtgttccttctattcaatttgtatcatttgatgatgtaggtcctgctctaggatttttgaatctgcgattgagactgaatgagggtttattgaattatgctggccacattggctactccattcgtccatcagaaagaggcaaaggttatgctaaagagactctccgtcagggcttgcaagttgctaaggaaaagaacatcaagagaactcttgtgacctgtagcgtgaataatcctgctagcagagcagtcattctagcaaatggtgggctccttgaagatgttcgtaatggagttgagcgttattggatagaggtagcgaatgaataatccaaaaccacaagaatggaaaagcgaggatctcagtcaagggcgtattattgattacaaggccttcaactttgtagatggagagggtgtgcgtaactctctctatgtatcaggctgtatgtttcactgcgagggttgttataatgttgccacttggtctttcaatgcaggaattccctacacagcagaattagaagaacagattatggcagaccttgcccaaccctatgttcagggattgaccttgctgggaggggagccttttctcaatactggcattcttttgccactcgtgaagcgtattcggaaggaattgccagacaaggacatctggtcttggacgggctatacatgggaagaaatgatgttggaaactccagataaactggaactcttatcattgattgacattcttgtcgatggacgatacgaccgaactaagagaaatctcatgctccagtttcgaggctcgtccaatcaacgaattatcgatgtgcaaaaatctctcaaaagtgggcaaatagtgatttgggacaaactcaatgatggaaaagaaagctatgaacaggtgaagagagattaactttcttctataaaaatagttaaataaatgacctataaaaaaagaaaacagtttcattgtaaaaaaacaaaaaaacagcaacaaatcccttgcaatcgcaggggctttgtgttattctattatggtgctgtaaattacagccttagctttgatgcaagaggttgcgacacgctcggttgcattgccacgcaacaccgcgtcggttttcttgtggagctagcctattatcttaaatagacgaaaaggagaaaaagatggcaaacaaaaaaatccgtatccgtttgaaagcttacgaacaccgtacgcttgacacagcggctgcaaaaatcgtagaatcagctactcgtacaggtgcacaagttgcgggtccaatcccacttccaactgaacgtagcctctacacaatcattcgtgcgactcacaaatacaaagactctcgcgaacaatttgaaatgcgtacacacaaacgtttgattgatatcgttaacccaactcaaaaaacagttgatgcgttgatgaaattggatcttccaagtggtgtaaacgtagaaatcaaactttaatctaaagcttgataccttgagcataaaaaacgctcgttaaaaactttttgaataaaaaatatagaaaaggaactattttctcatgacaaaaggaatcttagggaaaaaagtgggaatgactcaaatcttcactgaagctggcgaattgatccctgtaacagttattgaagcagctccaaacgttgttcttcaagttaaaactgttgaaacagacggatacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggtgctgaaatcacagttgaaacattcgcagctggagatgttgttgacgtaactggtacttctaaaggtaaaggtttccaaggtgttatcaagcgccacggacaatcacgtggaccaatggctcacggttctcgttaccaccgtcgtccaggttctatgggacctgttgcacctaaccgcgtattcaaaggtaaaaaccttgcaggacgtatgggtggcgaccgtgtaacaattcaaaaccttgaagttgtacaagttgttccagaaaagaacgttatccttatcaaaggtaacgtaccaggtgctaagaaatctcttatcactatcaaatcagcagttaaagctggtaaataataaggaaaggggaatacagtcaaaatggcaaatgtaacattattcgaccaaactggtaaacaagcgggcgaagttgttcttaacgatgcaatctttggtatcgaaccaaatgaatctgttgtgtttgatgtgatcatcagccaacgtgctagccttcgtcaaggaactcacgcagttaaaaaccgctcagctgtttcaggtggcggacgcaaaccatggcgtcaaaaaggaactggacgtgctcgtcaaggttctatccgctctccacaatggcgtggtggtggaatcgtcttcggaccaactccacgtagctatgcgtacaaacttcctcaaaaagttcgtcgccttgcgcttaaatctgtttactcagaaaaagttgctgaaaataaatttgtagccgttgattctcttgaatttacagctccaaaaactgctgaatttgcaaaagttcttgcagctttgagcatcgattctaaagtccttgttattcttgaagaaggaaacgaattcgcagctctctcagctcgtaaccttccaaacgtgaaagttgcgactgctacaactgcaagtgttcttgacatcgcaaatagtgacaaacttcttgttactcaagcagctatctctaaaatcgaggaggttcttgcataatgaatttgtatgatgttatcaaaaaacctgtaatcactgaaagctcaatggctcaacttgaagcaggaaaatatgtatttgaagttgacactcgtgcacacaaacttttgattaagcaagctgttgaagctgctttcgaaggtgttaaagttgcaaatgttaacacaatcaacgtaaaaccaaaagctaaacgtgttggacgttacactggttttactaacaaaactaaaaaagctatcatcacacttacagctgattcaaaagcaatcgagttgtttgctgctgaagctgaataatctaaggaggaaatatcgtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaacaaagacaacgttgaagcagttgttaaaacaattgagtacgatccaaaccgttctgcaaacatcgctcttgtacactacactgacggtgtgaaagcgtacatcatcgctccaaaaggtcttgaagttggtcaacgtatcgtttcaggtccagaagcagatatcaaagtcggaaacgctcttccacttgctaacattccagttggtactttgatccacaacatcgagttgaaaccaggtcgtggtggtgaattggtacgtgctgctggagcatctgctcaagtattgggttctgaaggtaaatacgttcttgttcgtcttcaatcaggtgaagttcgtatgattcttggaacttgtcgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaagcaccagttggtcgtaaagcaccatctactccatggggcaaacctgctcttggtcttaaaactcgtaacaagaaagcgaaatctgacaaacttatcgttcgtcgtcgcaacgagaaataatattaaactagtcgcttaagcaactagtaaatccgccagctcggtagcgctgcttgtgagcgcaagccgctgtggtacaacatttaaaggagaaaatataaaaatgggacgcagtcttaaaaaaggacctttcgtcgatgagcatttgatgaaaaaagttgaagctcaagctaacgacgaaaagaaaaaagttattaaaacttggtcacgtcgttcaacgatcttcccaagtttcattggttacactatcgcagtttatgacggacgtaaacacgtacctgtttacatccaagaagacatggtaggtcacaaacttggtgaatttgcaccaactcgtacttacaaaggtcacgctgcagacgacaagaaaacacgtagaaaataaggagaacataaatggcagaaattacttcagctaaagcaatggctcgtacagtacgtgtttcacctcgtaaatcacgtcttgttcttgataacatccgtggtaaaagcgtagccgatgcaatcgcaatcttgacattcactccaaacaaagctgctgaaatcatcttgaaagttttgaactcagctgtagctaacgctgaaaacaactttggtttggataaagctaacttggtagtatctgaagcattcgcaaacgaaggaccaactatgaaacgtttccgtccacgtgcgaaaggttcagcttcaccaatcaacaaacgtacagctcacatcactgtagctgttgcagaaaaataaggaggtaaaatcgtgggtcaaaaagtacatccaattggtatgcgtgtcggcatcatccgtgattgggatgccaaatggtatgctgaaaaagaatacgcggattaccttcatgaagatcttgcaatccgtaaattcgttcaaaaagaacttgctgacgcagcagtttcaactatcgaaatcgaacgcgcagtaaacaaagttaacgtttcacttcacactgctaaaccaggtatggttatcggtaaaggtggtgctaacgttgatgcactccgtgcgaaacttaacaaattgactggaaaacaagtacacatcaacatcatcgaaatcaaacaacctgatttggatgctcaccttgtaggtgaaggaattgctcgtcaattggagcaacgtgttgctttccgtcgtgcacaaaaacaagcaatccaacgtgcaatgcgtgctggagctaaaggaatcaaaactcaagtatcaggtcgtttgaacggtgcagatatcgcccgtgctgaaggatactctgaaggaactgttccacttcacacacttcgtgcagatatcgattacgcttgggaagaagcagatactacatacggtaaacttggtgttaaagtatggatctaccgtggtgaagttcttccagctcgcaaaaacactaaaggaggtaaataaccaatgttagtacctaaacgtgttaaacaccgtcgtgaattccgtggaaaaatgcgcggtgaagcaaaaggtggaaaagaagtagcattcggtgaatacggtcttcaagctacaactagccactggatcactaaccgccaaatcgaagctgctcgtatcgccatgactcgttacatgaaacgtggtggtaaagtttggattaaaatcttcccacacaaatcatacactgctaaagctatcggtgtgcgtatgggatctggtaaaggggcacctgaaggttgggtagcaccagttaaacgtggtaaagtgatgttcgaaatcgctggtgtatctgaagagatcgctcgcgaagcgcttcgtcttgctagccacaaattgccagttaaatgtaaattcgtaaaacgtgaagcagaataaggagaaggcatgaaacttaatgaagtaaaagaatttgttaaagaacttcgtggtctttctcaagaagaactcgcgaagcgcgaaaacgaattgaaaaaagaattgtttgaacttcgtttccaagctgctactggtcaattggaacaaacagctcgcttgaaagaagttaaaaaacaaatcgctcgtatcaaaacagttcaatctgaagcgaaataatagactagggaaggagaaatttcaatggaacgcaataatcgtaaagttcttgttggacgtgttgtatctgacaaaatggacaagacaatcacagttgtagttgaaacaaaacgtaaccacccagtctatggtaaacgtattaactactctaaaaaatacaaagctcatgatgaaaacaatgttgccaaagaaggcgatatcgtacgtatcatggaaactcgcccgctttcagctacaaaacgtttccgtcttgtagaagttgttgaagaagcggtcatcatctaatcaaacctgaaaggagaaaactgaaatgattcaaacagaaactcgtttgaaagtcgcagacaacagcggtgctcgcgaaatcttgactatcaaagttcttggtggttcaggacgtaaatttgcaaacatcggtgatgttatcgtggcatctgtaaaacaagctactcctggtggtgcggttaaaaaaggtgacgttgttaaagcagttatcgttcgtactaaatcaggtgctcgtcgtgctgatggttcatacatcaaatttgacgaaaacgcagcagttatcatccgtgaagacaaaactcctcgcggaacacgtatctttggcccagttgcacgtgaattgcgtgaaggtggcttcatgaagatcgtgtcacttgctccagaagtactttaatttttagaaacaaactagtcccctggatttacctccagggtgcccttatgggcgtaagaaaaatcaaggagaaacctaatgtttgtaaaaaaggcgacaaagttcgcgtaatcgctggtaaagataagggaacagaagctgttgtccttactgcccttccaaaagtaaacaaagttatcgttgaaggtgttaacatcgttaagaaacaccaacgtccaactaacgaacttcctcaaggtggtatcatcgagaaagaagcagctatccacgtatcaaacgttcaagttttggacaaaaatggtgtagctggtcgtgttggttacaaatttgtagacggtaaaaaagttcgctacaacaaaaaatcaggcgaagtgcttgattaatcacgaaggaaaggagaagtataatggcaaatcgtttaaaagaaaaatatcttaatgaagtagttcctgctttgacagaacaattcaactactcatcagtgatggctgtgcctaaagtagataagatcgttttgaacatgggtgttggtgaagctgtatcaaacgctaaaagccttgaaaaagctgctgaagaattggcacttatctcaggtcaaaaaccacttatcactaaagctaaaaaatcaatcgccggcttccgtcttcgtgaaggtgttgcgatcggtgcaaaagttacccttcgtggtgaacgtatgtacgaattcttggataaattggtttcagtttcacttccacgtgtacgtgacttccacggtgttccaacaaaatcatttgatggacgcggaaactacacacttggtgtgaaagaacaattgattttcccagaaatcaacttcgatgacgttgacaaaactcgtggtcttgacatcgttatcgtaacaactgctaacactgacgaagagtcacgtgcattgcttacaggccttggaatgccttttgcaaaataatataggaggtaaatctaatggctaaaaaatcaatgattgctaagaacaaacgtccagcgaagttctctactcaagcttatactcgttgtgaaaaatgtggtcgtccacattcagtttaccgcaaatttaaactttgccgtgtttgcttccgtgaattagcttacaaaggacaaatcccaggcgttaccaaagcatcttggtaatatcatgatacgaagagcgtaacaaccacagcaaaaataggaaatttggtgtaggagcgatgctccaaaacaaatttatcttttttgcacaggttgtagctcgtgttcaaataagagttttctcatttgaatgtatcaatactatctgagcctagctcaatcattaactagcaagtgcaacttgcaaactactagtaagaggagaaaaacaaaatggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcatcgaagatgacaaacaaggcatcatccgtgtattccttaaatacggaccaaacggtgaaaaagttatcactaacttgaaacgtgtttctaaaccaggacttcgtgtctacaaaaaacgtgaagaccttccaaaagttcttaacggacttggaattgctatcctttcaacttctgaaggtttgcttactgataaagaagcacgccaaaagaatgttggtggagaagttatcgcttacgtttggtaaaatcaagatacaaagctcgtaaagaacaaagcaaaattagaaagttggagaagtttgtttacaaacaagccaacttatctattttgcacagttcttagagcgtgttcagttcagctcttgaactaaataagtatctgaaccccgtgaaaactggccgttctggcctgacaatttaacaggagaaaataaacatgtcacgtattggtaataaagttatcgtgttgcctgctggtgtagaaatcactaacaatgacaacgttgtaactgtaaaaggacctaaaggagaacttactcgtgagttctcaaaagatattgaaatccgtgtggaaggtactgaagtaactcttcaccgtccaaatgattcaaaagaaatgaaaactatccacggaactactcgtgcccttttgaacaacatggttgttggtgtatcagaaggattcaagaaagaacttgaaatgcgcggggttggttaccgtgcacaacttcaaggatctaaacttgttttggctgttggtaaatctcatccagacgaagttgaagctccagaaggaattacttttgaacttccaaacccaacaacaatcgttgttagcggaatttcaaaagaagtagttggtcaaacagctgcttacgtacgtagccttcgttcaccagaaccatataaaggtaaaggtatccgttacgttggtgaattcgttcgccgtaaagaaggtaaaacaggtaaataatgttgagtggttgagtctcaaccaccaacctattttccaactttgtgcatagcacacgatttaaaactaaagaggtgaaaactgtgatttcaaaaccagataaaaacaaactccgccaaaaacgccaccgtcgcgttcgcggaaaactctctggaactgctgatcgcccacgtttgaacgtattccgttctaatacaggcatctacgctcaagtgattgatgacgtagcgggtgtaacgctcgcaagtgcttcaactcttgacaaagaagtttcaaaaggaactaaaactgaacaagccgttgctgtcggtaaactcgttgcagaacgtgcaaacgctaaaggtatttcagaagtggtgttcgaccgcggtggatatctatatcacggacgtgtgaaagctttggctgatgcagctcgtgaaaacggattgaaattctaataggaggacactagaaaatggcatttaaagacaatgcagttgaattagaagaacgcgtagttgctgtcaaccgtgttacaaaagttgttaaaggtggacgtcgtcttcgtttcgcagctcttgttgttgttggtgaccacaacggtcgcgtaggatttggtactggtaaagctcaagaagttccagaagcaatccgtaaagcagtagatgatgctaagaaaaacttgatcgaagttcctatggttggaacaacaatcccacacgaagttctttcagaattcggtggagctaaagtattgttgaaacctgctgtagaaggttctggagttgccgctggtggtgcagttcgtgccgttgtggaattggcaggtgtggcagatattacatctaaatcacttggttctaacactccaatcaacattgttcgtgcaactgttgaaggtttgaaacaattgaaacgcgctgaagaagttgctgcccttcgtggtatttcagtttctgatttggcataagaaaggggataaaatggctcaaattaaaattactttgactaagtctccaatcggacgcattccatcacaacgtaaaactgttgtagcacttggacttggcaaattgaacagctctgttattaaagaagataacgctgctatccgtggtatgatcactgcagtatctcacttggtaacagttgaagaagtaaactaatgaatttttaggggatgtgcactataccatcccctaaaactagatatagtcatctatgatgacgtcgtataggcgagttgatgggggagacaaccttttctcccttatcggcgctagcattttacaaaagaggagaaaataaaaatgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagttactccagttgttcttatcgaagcaggaattgttaaagctgaaaaatcaggtattaaaattcttggtaacggtgagttgactaagaaattgactgtgaaagcagctaaattctctaaatcagctgaagaagctatcactgctaaaggtggttcagtagaagtcatctaagagaggtgacctatgttttttaaattattaagagaagctcttaaagtcaagcaggttcgatcaaaaattttacttcacaatttttatcgttttggtctttcgtatcggaactagcattacagttcctggtgtgaatgccaatagcttgaatgctttaagtggattatccttcttaaacatgttgagcttggtgtcagggaatgccatgaaaaacttctcagtttttgctcttggtgttagcccctacattacggcctctatcgttgtccaactcttgcaaatggatattttacccaaatttgtagagtggggtaaacaaggggaagtaggtcgaagaaaattaaatcaagctactcgttatattgctcttgttctagcctttgtgcaatcgatcgggattacagctggttttaatactttggctggagctcaattgttgaaaacagctcttactccacaagtctttatcatgattggtatcatcttaacagctggtagtatgattgtgacttggttgggagagcaaattacagataagggatacggaaatggtgtttctatgattatctttgccgggattgttgcctcaattccagagatgattcagggcatctatgtggactactttgtgaacgtcccaagtagccgtatcaactcatccatcattttcgtaatcattttgattattactgtattgttgatcatttattttacaacttatgttcaacaagcagaatacaaaattccaatccaatatactaaggttgcacaaggtgctccatctagctcttaccttcctttgaaggtaaaccctgctggagttatccctgttatctttgcaagttcgattactgcagcgcctgcggctattcttcagtttttgagtgctacaggtcatgattgggcttgggtaagaacagcacaagaaatgctggcaacaacttcaccaactggtattgccatgtatgctttattgattattctctttacattcttctatacgtttgtacagattaatcctgaaaaagcggcagaaaacttacaaaagagcggtgcttatatccatggagttcgtcctggtaaaggtacagaagaatatatgtctaaacttcttcgtcgtcttgcaactgttggttctctcttccttggtgtgatttctattttaccgatcgtagcaaaagatgttttcggactttcagaagcagttgcttttggaggaaccagtcttttgatcattatctctacaggtattgaaggaatcaaacaattggaaggctacctattgaaacgtaagtatgttggtttcatggacagaacagaataaaagtaattactgaatcagtaattactgagggagtggaggtttaactctaacattagtgagagtttggtctcccctcttctattttgtttttaaataggggtgaaaaaactttttgcttctatttaaaaataaaataaggagatcaaatcatgaatcttttgattatgggcttacctggtgcaggtaagggaactcaagcagcaaaaatcgtagaacaattccatgttgcacatatctcaacaggtgatatgttccgtgctgctatggcaaatcaaactgaaatgggtgttcttgctaagtcatacattgacaagggtgaattggttcctgacgaagttacaaatgggatcgtaaaagaacgtctttcacaagatgatattaaagaaacaggattcttgttggatggttacccacgtacaattgaacaagctcatgccttggacaaaacattggctgaacttggcattgaactagaaggtgttatcaacatcgaagtgaatccagacagcctcttggaacgtttgagtggccgtatcatccaccgcgtaactggagaaactttccacaaggtctttaacccaccagttgactataaagaagaagattactaccaacgtgaagatgataagcctgagacagtcaaacgtcgtttggatgtgaatattgctcaaggggaaccaatcattgctcactaccgtgccaaaggtttggttcatgacatcgaaggtaatcaagatatcaatgatgtcttctcagatatcgaaaaagtattgacaaatttgaaataaagcgtttttcacacttgcaaaaatccgctacaaatgttatactgagatagtctgacttataattgttgtctctgtgtctagaggcatcgaatcgaaatttatggaggtgcttttgcgtggcaaaagacgatgtgattgaagttgaaggcaaagtagttgatacaatgccgaatgcaatgtttacggttgaacttgaaaatggacatcagattttagcaacagtttctggtaaaattcgtaaaaactatattcgtattttagcgggagatcgtgttactgtcgaaatgagtccatatgacttgacacgtggacgtatcacttaccgctttaaataatcgaaaaacttggagggataagaaatgaaagtaagaccatcggtcaaaccaatttgcgaatactgtaaagttattcgtcgtaatggtcgtgttatggtaatttgcccagcaaatccaaaacacaaacaacgtcaaggataagatagaaaggagaaaacatggctcgtattgctggagttgacattccaaatgacaaacgcgtagtaatctcattgacttatgtttatggtatcggacttgcaacatctaagaaaattttggctgctgctggaatctcagaagatgttcgtgtacgtgatcttacatcagatcaagaagatgctatccgtcgtgaagtggatgcaatcaaagttgaaggtgaccttcgtcgtgaagtaaacttgaacatcaaacgtttgatggaaatcggttcataccgtggtatccgtcaccgtcgtggacttcctgtccgtggacaaaacactaaaaacaacgctcgcactcgtaaaggtaaagctgttgcgattgctggtaagaaaaaataatataggaggtaaaagtcttggctaaaccaacacgtaaacgtcgtgtgaaaaagaatatcgaatctggtattgctcatattcacgctacatttaataacactattgttatgattactgatgtgcatggtaatgcaattgcttggtcatcagctggtgctcttggtttcaaaggttctcgtaaatctacaccattcgctgctcaaatggcttctgaagctgctgctaaatctgcacaagaacacggtcttaaatcagttgaagttactgtaaaaggtccaggttctggtcgtgagtcagctattcgtgcgcttgctgccgctggtcttgaagtaacagcaattcgtgatgtgactccagtgccacacaatggtgctcgtcctccaaaacgtcgccgtgtataatcatcgcattacactgcttttcgtttaagagggagtaactaaatgatcgagtttgaaaaaccaaatataacaaaaattgatgaaaataaagattatggcaagtttgtaatcgaaccacttgaacgtggctacggtacaactcttggtaactctcttcgtcgtgtacttctagcttctctaccaggagcagctgtgacatctatcaatattgatggtgtgttacatgagtttgacacagttccaggtgttcgtgaagacgtgatgcaaatcattctgaacattaaaggaattgcagtgaaatcgtacgttgaagacgaaaaaatcatcgaactggatgttgaaggtcctgctgaggtaacagctggtgacattttgacagatagcgatattgaaattgtaaatccagatcattatctctttacaatcggtgaaggttcttccctaaaagcgactatgactgttaacagtggtcgtggatatgtacctgctgatgaaaataaaaaagataatgcaccagttggaacacttgctgtagattctatttatacaccagttacaaaagtcaactatcaagtggaacctgctcgtgtaggtagcaatgatggatttgacaaattaacccttgaaatcttgacaaatggaacaattattccagaagatgctttagggctttcagcacgtattttgacagaacatcttgatttgtttacaaatcttactgagattgctaagtcaactgaagtgatgaaagaagctgatactgaatctgacgaccgtattttggatcgtacgattgaggaactggacttgtctgtgcgttcatacaactgtttgaaacgtgccggtatcaatactgtgcatgatttgacagaaaaatctgaagcagagatgatgaaagtacgaaatcttggacgcaagagtttggaagaagtgaaactcaaactcattgatttgggtcttggattaaaagataaataaaggaggaataaatggcttaccgtaaactaggacgcactagctcacaacgtaaagcaatgcttcgcgatttgacaactgaccttttgatcaacgaatcaatcgtgacaactgaagctcgtgctaaagaaatccgtaaaactgttgaaaaaatgattactctaggtaaacgtggtgatttgcatgcacgtcgtcaagcagctgctttcgtacgtaatgaaatcgcatctgaaaactatgatgaagcaactgataagtacacttctactacagcacttcaaaaattgttctcagaaattgcacctcgttatgctgaacgtaacggtggatacactcgtatccttaaaactgaaccacgtcgtggtgatgcagcgccaatggcgatcatcgaattagtataaaatcatcaattttgttgagtgttatgatgatggagtcttgtgctcttagtctagctctggtctaccgctaggatttcggtcctagcgggaacactcatcataagttgggatagtagacgcttgtttacgaaattgtttttttcttaagaacaacttcgtaagcaggcgtttttgagtattttagttagaattatgctatactatttgaaaagaatcctgtttaatgttcaggtttcctattaaaagaagaattggagtttgcttatgaaagcgattataactgttgttggtaaagataaatctggaattgttgcaggtgtttctggtaaaatagcagaattgggtttgaatattgatgatatctctcaaactgtcttggatgaatatttcacgatgatggctgtcgtctctagtgatgaaaagcaagattttacacgtcttcgtaatgaatttgaagcttttgggcaaattttgaatgtgaaaatcaacattcagagtgcagcgattttcgaagctatgtataatatctaggaggttatcatggatattagacaagttactgaaaccatctccatgattgaggagcaaaacttcgatatcagaactattaccatggggatttccctattggactgtatcgatccggatatcaatcgtgctgcggagaaaatttatcaaaagattaggaccaaggcagctaatttagtggctgttggcgatgaaattgcggctgagttggggattccaatcgttaataagcgtgtatcggtgactcctatttctctgattggggcggcgacagatgcgacagactatgtggttctggcaaaagcacttgataaggctgcgaaagagattggtgtggactttattggtggtttttcagccttggtacaaaagggttatcaaaagggagatgagattcttatcaattctattcctcgtgctttggctgaaacggataaggtctgctcgtcagtcaatataggctcaaccaagtctggtatcaatatgacggctgtcgcagatatgggacgagttatcaaggaaacggcaactctatctgatatgggggcagctaagttggttgtattcgctaatgctgttgaggacaatccatttatggcgggtgccttccatggtgttggggaggcagatgttatcatcaatgtcggagtttctggtcctggtgtggtgaaacgtgccttggaaaaagttcgtggacagagctttgatgtagtagcagaaacagtcaagaaaactgcctttaaaatcactcgtatcggtcaattggttggtcaaatggccagtgagagactgggtgtggagtttggtattgtggacttgagtttggcaccaacacctgcagttggagactctgtggcacgtgtccttgaggaaatggggctagagacagttggtacgcatggaacgacggctgccttggctctcttgaacgaccaagttaagaagggcggagttatggcttgcaaccaagttggtggtttgtctggtgcctttatccctgtttcagaggatgaaggaatgattgctgcagtgcaaaatggctctcttaatttggaaaaactagaagctatgacggctatctgttccgttggtttggatatgattgccatcccagaagatactcctgctgaaaccattgcagctatgattgcggatgaggctgcaattggtgtcattaacatgaagacaacggctgttcgtatcattccaaaaggaaaagaaggagatatgattgagtttggtggcctattaggaactgcacctgttatgaaagtcaatggggcttcgtctgtcgatttcatttctcgtgggggacaaatcccagcaccaattcatagttttaaaaattaagaaaataggagaaattttaagttctatttaaggttggatgtgtatactataatcattaaataaagacctcctaatattatttgaaacagataacactgatttagtttgaatttgattttcatctaatatctttatttaatagaactcctaaactttttcataataatctcctgcaaaagtcacctgtctgggtggcttttgttttatcatccatgatataatagaagcaaacggaggacggaaaatggtaaaagtacgattgtatttggtacgtcatggcaagactatgtttaacacgattggtcgcgcgcaaggttggagcgatactcctttaacggctgaaggtgagcgagggattcaagaattaggaatcggtttgcgagaatctggtctacagtttgatcgcgcttattccagtgattctggccgcaccattcagacaatgggaattattcttgaagaacttggtttgcaggggaaaatcccttatcgcatggacaaacgtatcagagaatggtgttttggtagctttgacggagcttatgatggtgatcttttcatgggcattattcctcgtatctttaatgtggatcatgttcaccaattgtcttatgctgaactggctgaggggttggtagaggtcgatacagctggttgggctgaaggatgggaaaaactcagtggccgaatcaaggaaggttttgaagcgattgccaaagaaatggaagagcaaggtgggggcaatgccctagtcgtgagccacggaatgaccattggaaccattgtgtatctgattaatggcatgcatccgcatggtctcgataatggtagcgtgacgatacttgaatatgaggacggccagtttagcgtagaagttgtcggtgacagtagttaccgagaactaggacgtgagaagatggaggaagtctctatttaattagtctagacttgcttgcaatgaactaggaatctagtaggaatatcaaaataagaaaaaacagccgaagtaatcctttcggctgtttttgatggggaaaactaaagtgtaatgctattgcttttagagattttcataaacaagagcaaggaacctactgttagaacagtcaggatagttgataaggctgcggctacaccgtaattccctctgagaacctctgtataaatggctacagtcattgttcttgttttgacattgtagaggaggatagaagtagagagttctgaaatcattgtaacccaagataggatagctccagaaataataccagatagcatcattggagttgtaatcttggcaaaggtattgagacggctacttcctaagctttcagcagcttcttcaatacttggtgctatttgttgcaagctagcaacagatgagcgaatagtatacggtaatcttctgacagatagagacataatcaagatgaaagcagttcctgtaatcataagaaatccacttccaaatagaccggtattgaaggaagaaatgaaggcaatccctagaacggttcctggtacaatataagggaccatactgaggctgtcaattaagtttgtaaacaaattccgttttctaacggctaggtaggagataaatgttgcgaataggacaactagaactaaggcaatcaaagggatacgaatggtattgaaaatagcagatcccatacgattgaaagccaccttgtaactgtttagagaataacctttgacaaataccatacctgatgtttttaggaaagaagtataaatcaagtagacttgaggtagaacagagaacaagataattccgtagactgttgcataaatggcagccatttttccttttgtagtttttttaggctcaattggatggagcgaattcatgctgaaactgtagcggtttgagatgtatttttggataaggaaaatcgccaaggcaatgataatcgccataattgctaaagcagatgcaaaagcagaatttcctccaacctcgctaatgaattgggtataaatcaagacggggaaagtccgatatccttcaccaatcaacataggcgttccaaagtctgagaatgctctcataaatacaagcagggcagctgctagtaaggttggaactaggagaggtaaaacaaccgttacgatacgcttaaatccgaaggaccccatgctttcagcggcttcaagtagagaattgtcaatacttttcattgtaccagcaacgtatagaaataccagtgggaatagttgcagtgtaaagacaagtacaattcctttgaatccataaatatcgatagctggaagatgaagagaatttgtcaggaatttagtaattaccccatttcgtcccagcaagagaatccaggagtaggctcccacgaaaggagctgacatagaagcaatgataatcaatatttgtagaaatttctttcccttgaagtcatacatagagaagagataagctaatagggttcctacgactaaggaagtgacagtagcggtaatggagaccttgaaactgttgacaagtgtctcagagtagtaagctttactaaagaaagtgacaaaattagctagtgagaattgtccttcatgtatgagtgcttgcttgagcacggtaacgataggataaacgagaaagacaagataagtaagaaagatgaagaaagaggaggctgtccaaatatttagttttttacgttccatggttgactccttttatcaggttttgtgaaccatttgcagaaaagacatttaatttttgagtattgattcgtagacgaatacgatcgcctttttgtagatcttcttcaaaagttgattcttcgctaacctgaatttttgaggcaaatcctgtttcgatgaagtattcagtattcagtccaagatagacgctatcgctaataattccttcaatatctccagattcatctttgataaactcttcaggacgaatacttacatgaatggcttgctcctcagcctgatcaagagctggcattcgaagagcatagccatctgaaaagacgatataagcgccgtcgctccgtttttcgagattggcagggataatatttgtgcgtccgataaaggttgctacaaactcattagctggtttatgatagagttcttttggtcgaccgatttgttggatgactccgtctttcataacagcaatttgatctgaaatagccatagcttcttcttggtcgtgggtcacataaacggttgtaattcccacttcgtgttggatttctcgaatggcttgacgcatatccaagcgaagtttggcatctagattactaagtggctcgtccatgaggagaacacttggattaaccgctaaggcacgtgccaaagcgacacgttgttgttgtccaccactgagtttatcgggctttcgatccgcatattgaacaatttgcatgagttcaagatatttattggtttgttgaatcaattcttcttttggaaccttcttttgcttgagaccaaaagcaacattatctcggacagtcaaatgtgggaaaatagcgtagttttggaaaaccatcccgatattgcgtttgctgggttccatattattgatttttttatcatcgaagtaaaattctccgccttcgatactgttgaaacctgcaatcatacgaagaagggtcgttttcccacaccctgaaggcccaagaagggtaaagagacttccttttggaattgtaatgttcaaattctcaataacagggacatcgtgatagattttttttgcgttaataattttgatctcactcatagtgaacctcttttactgtttagattggatatctgtaaagacttcgttgtattttttaacgatatctgatttattcttgatgacataatcataatcttcagtgagtgttttgattttgtcaattggtttcatattttcgctcgttttagcatttttacgaacaggacggttagtagtggttgtaccaagtgtatcttgtacttcttgagagataataaaatcgataaattttttggcattttccatatttttagcttttttaacgatagcagcactagcaggtaggaagactgttccttcttttggatagactaccttaatgttagctccgtcatttaagagtttaactgctggatcttcataagagagaccaacagccatttctccgtcagcgactgctttatagacaccagatgagcttgaaccgattttaccatcaataagtgtgaagagatcttttacataagaccaagctttatcgtctttgtaaccaccttgagcttgtagcatatttgttaattgagcaaaggcgctagaagagtttgctgggtcagcagttgcgatttttccttttagttcaggtttgagaaggtcgctatatccttcgatgttcatgcctttcgttaaatcaggattgacgattaaaacactaccatctagtgtataaggagtagagtagccagttgtgttttgatattctttgataacattatcattttcttttgaagtatagttttcaaagagttctccgtgggtagcatattgtgtataagaaccaccaaagataacatcggctacaggagcttctttttctgactctagttttttgaaaagttctccagtaccagcttgaatcagttctactttaataccgtatttttcttcaaaggcgggaatagttgctccaattaagccctctgagtttggtgaataaacgactagcgaaccgccgtctcctttatcagatgaactgtcatcggcagattcactagaagaacaagcggcaagaccaaaaagagctagtccgcaagcagcataatacatccatttctttttcatgatggatacctccgttatgttatttaagtttattttaaaataatgtaagcgtttttaaaaccgataattctattctattagagtaaaattctctacaaaaacggaagcaatctttttgattttatagtagggtgcgacagttaatcattgggaaatcaaattttattttttagatagaatatctgtgaaaatatcattgtactttttaagaatagtggatttatttttaatgacataatctgaatcttcggtggcaatcttgatttctgtcatagccttcatatttttattggttttagcatttttacgaatgggtctgattgttgtttcagttcctagcttatcttggatttcttgagaaaggaggaaatcgataaatttcttagcgttttccatgtgtttggcatttttgacgatagctgcgttaccaggtaaaaagacggttccttcttttggataaatgacttttacatcaaccccatcatttaagagttttaaagcaggatcttcataggtgagtccaacagccatttccccatcggcgacagctttgtaaacatttgaagaactagatgcaatctttccatctactagggtaaatagattttttacataggtccaagcttgttcattttcgtatccaccttggtctacaagcatgtttgttaattgagcaaaggcactagaagcattacttggatcagcagtagcaatttttccttttaatttaggattgagtagatcattgtagccttcaatttttatatcttttgtaagggctgaattggcaatgataacactgacatccagtgtgtaaggggtgtagaatccagttttattttgatattcagggattatctggtcgttttcttgagaaatataaggttcaaaaagtttttcgttagaagagaagagggcgtaggagcctccgaaaatgacatcggctactggggattctctttcggcctcagcttttttgaataattcaccagtgctggcttgtactaaatcaaccttaataccatatttttcttcgaaggaagggattgtttcttcgataaggtcttcagggttaggcgagtagacaaccaaagtgttatctgaatctttttcagcgctagtttctgcttctataggtgaagaacatcctgataaagaaaggaatatccatccacaagagagaaagaatagtatttttttcataagtatctccttttttacgaacaatttctctacctagattgttaatgtttttaaattgtagagttctacaggatataataaaaaccttaaagaaatctaaaacgggaaataggaaatgggttcctagagcaaggatgggtgaattgtagctgagattttgatggtaatactcttcaaaacacgtcgctttatctgcaatctcaaagctatgatttgagtagttagcactttgattttcattgggtaaaagcacaaaataaaaagattgcctgagctgagcaatccttttacatcaatggtttttatccatgagttttaattcttttggagaaatatggagatactttttaaaaacttttgcaaaatatttatagtctgaaaatccaatttgttcagagatatcgcttaggggggaattgggggattcagccattttatctatagcttgcttgaggcggtagcgtaagatatattcatttagcgtcattgggaagtcttctttgataaccttatatagataactttcgctataccctagattctctgcaatgctagaaatggtaaagtgcatacagtagtgttgatgaacaaattcaagaatttgctgaatgatttggttttgtgtatcaatttgttggatagaggtaagtaaagtttgatattcttctaaaaaaggagtttcttgacgagtgctaactcgtaatcgcaaaacaattttttgaagacattctgtcaactccttggtatcaattggtttggataagaaatcaactgccccatattgcatggcttttttggcattttgaaaatcgttataacctgataaaataactttttcataggagagagtacgagtggcttcgaacatcataaaagcatccataattggcattgtgatgtctgttaagacaatatgaggttctttttcttggatgagtttcattccctcttgaccgtgactggcagttcctactacttggatacctaaggcagagtagtctacggcaatctctagccattttcgaatgaggtgttcgtcttctacgataatgagcttaaacatgagttagtcctttcgttataaatttgacccaagtttctccttggcgattgactcctaaatctagctggacatcagaaaagaaattgctcaatcgtttatagctgttaacgatgccatgctgggtatgagggctttctaaagagtctaaaatagcgagtcgctcttgttttgtgagtcctccagcattatccttgactaaaaaagttagagaatctgcttccaaggtaatttggatatcaatatgaagatcaatacggtattgcatcccatattttatagcattttctactagaggaagcaagaaaagtttaggaataggttgattatcgatagtttctgggcagacaatatcataggaaaagtgctcgaaacgaatcttatgaataataaggtaatcctctataatctttaaatcttggcaaatggttgtttctttttctaaatcggtgatactgtagcgaagaatgcgcgtgagattttgaatcaggtcttgtgtgagagctgcatccattaaagaagtgattttaatcgtctcaagtgtattgtagagaaaatgaggattgaactgagcttccagcatttttctttcaaaaatccacttttctttttcgatggtcaacattttctgatgaagttgatctaattcatacaacatattattaatttttcggccataaattcaaactcatcacctgtttgtagagaaagtcttttttctgcttgtttgggaatttcttgaagttggtaaactaagctttcaataggaacagcgttgtgtgtagcaatcttatgagcaattcgtcttgcttgccagaagtagaggaagaatatacataaggtgagaatggaggctaggccgagtaagctaggaataggaaaaaaggattgaaaagtatagattgaaaaaatagcaccgactttttctttttgaacaataagcggttcattctcataccagtgggtacgagagtgtaggagtttttcatcaaatttttcaagagtggagcgagtgaactggtttgtattgttggaaaacatatttccaaagctatcggtaatgatgtatttagaatttatcattgggaaacttgagatgaaatcattctcatttacgaaagcaatcgtataggctataactcgttggttttgaagtagtggtttgataaagagtgtgtaatgttgcttatctgaagagagtgcaattttttctgtaactttttcttgagaaggattttgaatgagcagttttagatagtagggagataaaatactttcttgatgattgcgattggtactaaatagtaattcacctgtatcacttaggataatgaggtcagaactaagttttaatttagcttttgtctcgtaaaataagctaaagacttctctctctgtgtgtttgccatccaaaaatccaggaatcattttatagttcatagtggtcaggagctcattatttgcttctttcatctcttgaacttgtttgacaatctgtctcgtgtctttggagagttgttgcttttgtaaaaaataggaaaaaccaaaaagtaaaatgagtagtaaaagagaggtcataaaggctgcgatagagcttctatggagaatttctttttggagagattttttaaaggaatgagacatccgctacctccttggaagggttttttgttataagtatagcagtttaaaaattctagagcaaggtaaaatagaaaagtatagaatagaacgagaccaaattccctcaaaaatggtataatagtaacatcacaaaattggagagagaccatgagtttttataatcataaagaaattgagcctaagtggcagggctactgggcagaacatcatacatttaagacaggaacagatgcatcaaaacctaagttttatgcgcttgacatgtttccgtatccgtctggagctggattgcacgtaggacacccagaaggttataccgcaaccgatatcctcagccgttacaaacgtgcgcaaggctacaatgttcttcacccaatgggttgggatgcttttggtttgcctgcagagcaatacgctatggatactggaaatgacccagcagaatttacagctgagaacattgctaacttcaaacgtcaaatcaatgcgcttggattctcttacgactgggatcgtgaagtcaacaccacagatccaaactattacaagtggacgcaatggattttcactaagctttacgaaaaaggcttggcctatgaagcggaagtgccagtaaactgggttgaggaattgggaacagccattgccaacgaagaagtccttcctgacggaacgtctgagcgtggaggctatccagttgtccgtaaaccaatgcgccaatggatgctcaaaatcacggcctatgcggagcgtttgcttaatgacttagatgaacttgattggccagagtctatcaaggacatgcaacgcaactggattgggaaatcaacgggggctaatgtaacttttaaagttaagggaacagacaaggaattcaccgtctttaccactcgtcctgatactcttttcggtgcgactttcaccgttttggctcctgagcatgaactagtagatgccattacaagcacagagcaagcagaagcagtagcagactacaaacaccaagccagtctgaaatcagacttggctcgtacagaccttgccaaagaaaaaactggtgtctggacaggtgcttatgccatcaaccctgtcaatggtaaggaaattccaatctggattgccgactatgttcttgctagttacggaacaggtgccgttatggctgtgcctgcccacgatcaacgtgactgggaatttgccaaacaatttgatcttccaatcgtcgaagtacttgaaggtggaaatgtagcagaagctgcctacacagaagatggccttcatgtcaactcagactttctagatggactcaacaaagaagacgctattgctaagattgtggcttggttggaagaaaaaggatgtggacaagagaaggttacttaccgtctccgcgactggctctttagccgtcaacgttactggggtgaaccaattccaattattcattgggaagatgggacttcaacagcagttccagaaagtgaattgccacttgtcttgccagtaaccaaggacatccgtccttcaggtacaggggaaagtccactggctaacttgacagactggcttgaagtgactcgtgaagatggcgtcaaaggtcgtcgtgaaaccaatactatgccacagtgggctggttcaagctggtactacctccgctatatcgacccacacaatactgagaaattggctgatgaggatcttctcaaacaatggttgccagtagatatctatgtgggtggtgcagagcatgccgttcttcacttgctttacgctcgtttctggcataaattcctctatgacctcggtgttgttccgactaaggaaccattccaaaaactctttaaccaaggaatgattttgggaaccagctaccgtgaccaccgtggggctcttgtggcaaccgacaaggttgaaaaacgtgacggttctttcttccatgtggaaacaggagaggagttggagcaagcgccagccaagatgtctaaatcgctcaagaacgttgttaacccagatgatgttgtggaacaatacggtgccgatacccttcgtgtctatgaaatgtttatgggaccacttgatgcttcgattgcttggtctgaagaaggtctggaaggaagccgtaagttccttgaccgtgtttaccgtttgattacaagcaaggaaattgttgcagaaaacaatggctctctcgacaaggtttacaacgaaaccgttaaagctgtcacagagcaaatcgagtccctcaaattcaacacagccattgctcaacttatggtctttgtcaacgctgctaacaaggaagacaaactctatgtggactacgccaaaggctttatccaattgattgccccattttcacctcacttggcagaagaactctggcaaacagttgcggcaacaggtgagtcaatctcttacgtggcttggccaacatgggacgaaagcaaattggttgaagacgaaatcgaaatcgttgtccaaatcaaaggaaaagttcgtgccaaactcatggtcgctaaagacctatcacgcgaagaattgcaagaaattgctctagcggatgaaaaagtcaaagcagaaattgacggtaaggacatcgtgaaagtaattgcggtacctaacaaactcgttaatatcgtcgttaaataacgagtttattagctctatctgccaccttcaatagtccactggactattgaagccaaccaaattggttaatattgttgtgaaataagataggaatccttcagagtagaatctggaggattttttgagtcttcttatgaaagtatgatatactatgggcaactataaagtttggaaagcaaaacaaggggaaagttatgccagtaaatgaatatggtcaaatgattggtgagtcaatggaaggttatacaccaggtgaactgccttctattgatttcttagaagggcgatatgctcgaatagaagctctttcagtggaaaagcatacggaggatttattagctgtttatggtccggatactcctcgggagatgtggacctacctttttcaggaaccagtggcagatatggaggagctggttacccttttaaatcagatgttagctcgtaaggaccgtttttactatgcaatcatagacaaggaaactggtaaagttttaggaactttttctctcatgcgtattgaccagaataaccgagtaatagaagtgggagctgtcactttttctccagagctcagggggacacgaatagggacagaagcccagtatctcctggcgcgctatgttttcgaggaacttaactatcgtcgctatgagtggaaatgcgatgctcttaacctgccatcaagacgagcagcggaacgtttgggctttatttatgaaggaaccttccgtcaggcagtggtttataaggggcgcacgagggatacggattggttgtctataattgataaggattggcccaaagtaaaatctcgtttggaaacatggttgcgtcctgaaaattttgacaaaaatggacagcagtacaagagcttgagagaactctaagaggtgttgagatgattactattaaaaagcaagaaattgtcaagctagaggatgttttgcatctctatcaggctgtcggttggacaaattatacccatcaaccagagatgctggagcaggccttgtctcattcattagtaatttatctggcacttgatggtgatgctgtggtgggcttgattcgtttggttggcgatggattctcatcagtttttgtacaggatttgattgttttgcctagctatcagcgccaagggattggtagctccttgatgaaagaggctttagaggattacaaagatgcctatcaagtccagctggtgacagaccagacagaaagaaccttgggcttctatcgttctatgggctttgaaatcttatccacctataattgtatagggatgacttggatgaatcgagaaaaataacaaaacttatttttcttaagcaaagtttaaggctggtctagtattatatagtcattaaataaagacctcctaactttatttaatgaaatcctaaaaacttttttcatcataatctcctaatgaagtcacccaatcaggtggctttttttcttggataggtgatggtgatagaaattttttgcaaaatagcaaaatttgagaaaagttaagctatttttaagcttcgtcttgtatcatatagttattaagtaaagacctcctaactttatttaataaaatcctaaacttttctttttcataataatctcccttgactccacccaatcaggtggagttttttggctctatttcaggcttttggagactattctaaaaatcatttttcgatatttttcggattttggtcggggatttttttagagaatatgagtaagaaataggtctgttgttatttaagtgaattcaaccttaatttgattgtaggtgactgttaattgaaggaatggaactattgtaatgatgattttacttgtccagtagtggcgtattaaatgaggagtgatatgtaagcttgtctcttcgtttacgaaatcaaaatttttatgaaattgatagaatccctaactttctcttaatcttgaccgttttgttgtacagcggttaaagcttgaaaagccgagaatgtaaacctttgacaaaatttgtgaactgtaggataatggagaggaattaaggattagttctatattatggactagaaaagaccccaagctaacttccacattaagcttagggtcttttttgacactatctatcttcgtttagccatttatcgactaagcgaaggatgacaccgaccacaatcggtccgatgatagttttaaggattagttccatcatgagctatctcacctcctttcgtaggcggtgtagtagtgccgtataatattattccacataagtgttaaactcgggagtcacccaatcgggtggcttttttgtttgtggcttggttttttgatataatagagcaatgagtagaattttagataatgagataatgggggacgaggagttagtagaacgcacgctccgtcctcagtacttacgtgaatatattgggcaggacaaggtcaaggaccagctccaaatctttatcgaagctgccaaaatgcgggatgaagcgctggatcatgtgctcttatttggccctccaggcttgggaaaaacgaccatggcttttgttattgccaacgaactaggtgtcaatctcaagcagacttcgggtccagtcattgaaaaagccggagatctggtagcgattttgaatgacttagagcctggggatgtcctttttattgatgagattcatcgcttgcccatgtcggtggaagaggtgctttatagtgccatggaagacttctacattgacatcatgattggggctggtgaaggcagtcgcagtgttcatttggagttgccacctttcactttgattggtgcgacgactcgggctggtatgctctcaaatccgttacgggcacgttttgggattacaggtcatatggagtattatgcccatgctgacttgacggaaattgtcgagcggacggcagatatttttgagatggaaatcacccatgaggcagcatctgagttggcattgcgtagtcgtgggacccctcgtattgccaatcgtctcctcaagcgcgtgcgcgattttgcccagataatggggaatggggttatcgatgatcttattaccgataaggctttgactatgctggatgttgaccatgaaggtttggactatgtggatcaaaaaatccttcgcaccatgattgagatgtacggtggtggtcctgttggtctaggaactctttctgttaacatagcagaagaacgtgagacagttgaagatatgtatgagccttacttgattcaaaaaggttttatcatgcggacgcggtctggacgggtggcgactgctaaggcatatgagcacttaggttatgaatatagtgaaaaatgagcaagaaattctagaggattttagagaaaatccggatatgatggctattctgactgtcatccgaaacttggagttgacagattcctggttggcagcaggttctgtcagaaattttatctggaatctcttgtcagacaaatccccttttgactgtgaaacagatgtagatgtaattttctttgatccagatatttcttacgaggaaaccttgtccctagagaaaaaactgcgagaggactttcctcagtaccagtgggagttgaaaaatcaggtctatatgcaccagcacagtcctcacacttctccctataccagttctcgtgatgctatgagtaagtatccagaacgatgtacggctgttggactgcgcttgaatgaagaatccgattttgaactctatgcaccttatggtttggaggatattttgaattttcaagttcgtccaactcctcattttttagagaatcaagacagaatggaactttatcgaacacgtctatccaagaaaaattggcaggagaaatggaaaaatttgatttttaaaaatacttaaggaaactttaagctaggaagtgtatactaagtccataagttaagaagaccttaacttaaactcctaaaactttttcataataatctccctataaaaaatagagtcgcccaatcaggcggcttatttttttgaaaaatgggcttggtgcctgagaataatactcaatgaaaatcaaagaccaaactaggaagctagccgcaggttgctcaaaacactgttttgaggctgcagatagagctgacgtggtttgaatttgattttcgaagagtataaatagcttagtgatagaagaaaatagggaaatatggtataatgaaacgatagatttttgaataggaataagatcatgtttggattttttaagaaagataaggctgtggaagtagaggttccgacacaggttcctgctcatatcggcatcatcatggatgggaatggtcgttgggctaagaaacgtatgcaaccgcgagtattcggacataaggcgggcatggaagcattgcaaactgtgaccaaggcagccaacaaactaggcgtcaaggtgattacagtctatgctttttctacagaaaactggacccgtccagatcaggaagtcaagtttatcatgaacttgccagtagagttttatgataattatgtcccggaattgcatgcgaataatgttaagattcaaatgattggggagacagaacgcctgcctaagcaaacttttgaagctctgaccaaggctgaggaattaactaagaacaacacaggattaattcttaattttgccctcaactatggtggacgtgctgagattacacaggctcttaagttgatttctcaggatgttttagatgccaaaatcaacccaggtgacatcacagaggaattgattggtaattatctttttacccagcatttacctaaggagttacgagacccagacttgattatccgtactagtggagaattgcgtttgagcaatttccttccatggcagggagcctacagtgagctctattttacggacaccttgtggcctgattttgacgaggcggccttgcaggaagccattcttgcctacaatcgtcgtcatcgccgatttggaggagtttaggaggaaatatgacacaggatttacagaaaagaaccttgtttgcagggattgccctggctattttcctaccaattttaatgattgggggcctcttgcttcagatagcaattggaatcatagccatgctagccatgcatgaacttttgaagatgagaggtctagagaccatgactatggagggcctcttaaccctctttgcaacctttgctttgaccattcccttggagaattatctgacttttttaccagttgatgggaatgtggttgcctatagtgttttgatttcaattatgttaggaacgactgtttttagcaagtcttatacgattgaggacgctgttttccctcttgctatgagtttctatgttggctttggatttaatgctttactagatgctcgcgttgcaggtttagataaggctctattggccttgtgtatcgtctgggcgacagacagtggtgcctatcttgttgggatgaactatggtaaacgcaaattagctccgacagtttctccaaataaaacctttgagggtgccttgggtggtattttaggtgcgattttagtaactattatctttatgatagttgacagtacagttgctcttccgtatggaatttacaagatgtcagtctttgctattttctttagcattgctggacaatttggtgatttactagaaagttcgattaagcgtcactttggtgtcaaggattctgggaaatttattcctggacatggtggtgttttggatcgttttgatagtatgttgcttgtatttccaatcatgcacttgtttggactcttttaatcaaaagacggaggaaatactatgctcggaattttaacctttattctggtttttgggattattgtagtggtgcacgagttcggacacttctactttgccaagaaatcagggattctagtgcgtgaatttgccattggcatgggacccaagatctttgctcatattggcaaggatggaacggcctataccattcgaatcttgcctctgggtggctatgttcgcatggccggttggggtgatgatacaactgaaattaagacaggaactcctgtcagtttgacccttactgatgatggtaaggttaaacgcatcaatctttcaggtaaaaaattagatcaaacagccctccctatgcaggtgacccagtttgattttgaagacaagctctttatcaagggcttggttctggaagaagaaaaaacatttgcagtagatcacgatgcaacggttgtggaagcagatggaactgaggttcgaattgctcctttggatgtgcaatatcaaaatgcgactatctgggggaaactgattactaactttgcaggtcctatgaacaactttatcttaggtgtcgttgttttctggattttaatctttatgcagggtggtgtcagagatgtcgataccaaccagttccatattatgcctcaaggggctttggctaaggtaggagtaccagaaacggcacagattaccaagattggttcacatgaggttagcaactgggaaagcttgattcaagctgtggaatcagaaaccaaagataagacggccccgaccttggatgtgactatttctgaaaaggggagtgacaaacaagtcactgttactccggaagaaagtcaaggccgttaccttctaggtgttcaaccggggattaagtcagattttgtatctatgtttgtaggtggttttacaactgctgttgactcggccctccgaattctatcagatctgaaaaatctgattttccaaccggatttgaacaaactaggtggacctgttgccatctttaaggcaagtagtgatgctgctaaaaatggaattgagaatgtcttgtacttcttggcaattatttccatcaatattgggatttttaatcttattccgattccagccctggatggtggtaagattgtgctcaatatcctagaagctatccgccgcaaaccattgaaacaagaaattgaaacctatgtcaccttggccggagtggtcatcatggttgtcttgatgattgctgtgacctggaatgacatcatgcgactcttttttagataatcgaggaatattatgaaacaaagtaaaatgcctatcccaacgcttcgcgaaatgccaagcgatgctcaagttatcagccatgctcttatgttgcgagctggttatgttcgccaagtttcagcaggcgtttattcttacctaccacttgctaaccgtgtgattgaaaaagctaaaaacatcatgcgccaagaatttgataagattggtgccgttgagatgttagctccagcccttctcagtgcagaattgtggcgcgaatcaggtcgttacgaaacttatggtgaggacctttacaaactaaaaaaccgtgaaaaatcagacttcattctaggtccaactcacgaagaaacctttacagctattgtccgtgattctgttaagtcttacaagcaattgccacttaatctttatcaaatccagcctaagtatcgtgatgaaaaacgcccacgtaatggacttcttcgtacacgtgagttcatcatgaaagatgcttacagtttccacgctaactatgatagcttggacagtgtttacgatgagtacaaggctgcttatgagcgtattttcactcgtagtggtttagatttcaaggctatcatcggtgacggtggagccatgggtggtaaggacagccaagaatttatggctattacacctgctcgtacagaccttgaccgatgggttgttttggacaagtcagttacctcatttgatgaaattcctgcagaagtgcaagaagaaatcaaggcagaattgcttaaatggatggtttctggtgaagataccattgcttactcaagtgagtctagctatgctgctaacttggaaatggcaacaaacgagtacaaaccaagcaaccgtgtcgttgctgaagaagaagtgactcgtgttgcaacaccagatgttaaaacaatcgatgaagttgccgccttcctcaacgttccagaagaacaaacgattaaaaccctcttctacatggcagacggtgagcttgttgccgcccttctagttggaaatgatcagcttaatgaagttaagttgaaaaaccacttgggagcagatttctttgacgttgctagcgaagaagaagtggcaaatgttgttcaagcaggatttggttcacttggcccagttggtttgccagagaatgttaaaatcattgcagatcgtaaagtgcaagatgttcgtaatgcagttgtgggtgctaacgaagatggctaccacttgactggtgtgaacccaggtcgtgattttactgcagaatatgtggatatccgtgaagttcgtgagggtgaaatttcaccagacggacaaggtgtccttaactttgcgcgtggtattgaaattggtcacatcttcaaacttggcactcgctattcagcaagcatgggagcagatgttttggatgaaaatggccgtgctgtgccaattatcatgggatgttacggtatcggtgtcagccgtctcctttcagcagtgatggagcaacacgctcgcctctttgttaacaaaacgccaaaaggtgaataccgttacgcttggggaatcaacttccctaaagaattggcaccatttgatgtgcacttgatcactgtcaatgtcaaggatgatgaagcgcaagccttgacagaaaagcttgaagcaagcttgatgggagctggttatgaagtcttgacagatgaccgtaacgaacgtgttggtgttaaattcagcgatagcgacttgattggattgccaatccgtattactgttggtaaaaaagcggccgatggtatcgtagaagttaagattaaagcgactggtgacactatcgaagttcatgcagataacttgcttgaaacgcttgaaattctcagcaagaaataaaaactataatcagaagaaaaacaaggaaaaaatgtaactagtttttaccttgttttttctgtataatgggaaaaatgagtagataaagaggtaaatgtatgctaagatttccaaaggattttgtctggggatcctctacttctggaccacaaacagaaggacgtgtagcttgtgacggtaagggagataatctctgggattattggtaccaagtggagccaaatcgttactataatgggattggtccagataaaacatcaaccttttatgaaaactgggaaaaggatattgacctcttgttagaaactggtcacacggcctttcggacttctattcagtggtcacggatttttccacaagggcgtggggaagtcaatcctcaaggtgtagacttttaccgtaaggtttttgaggctattaaggccaaagggattcgtcttttagtcaatctttatcattttgatttgccttttgcccttcaagaggatggtgatggttgggaaaataaggcgactgtttcagcctatgaagactatgctcgtttttgttttgagacttatggagatttagtggatcaatggattacctttaacgagccaatcgttccagtagaatttggctatttttacgatgcccattatccacataaggtggatgcagaggcagccgttaaagtagcttatcatacacaattggccagcagtcgggtggttaaggcttgtcatgaacttttgccagattccaagattgggattgtcttaaacttgacaccggcttatccacgtagccagcatcctgctgatgtcaaggcagctcgcattgcggacctttttcaggcccaatctttcttagatccgtctgttttggggacttatccacaggagttggtagaaatcttgcatgaacacggtctcttacctgatgctacagaggaggagttggaactcattcgtgacaatacggtagacttccttggtgtcaactactatcaacctttgcgtgtcatggctcctcgatttgctaagcatccagagagtccactcttaccagaacatttttacgaggcttatgtgatgcctggacgtaaaattaatcctcatcgtggctgggagatttatgagcaagggatttatgacatcgcccaaaagatcaaggaaaattatggtaatatcgagtggatgttgactgagaatggtatgggtgttgaaggggaagaaaaattccgtcaagatggaatgattcaagatgattaccgtattgactttgtaaaaggtcatcttcgtgaactgcaccgtgccattgaagacggagccaattgtaagggctacttgatttggacctttattgattgctggtcatggctcaacagctataaaaatcgctatggtttggtcgaattagacttggaaactcaagaacgtcgtctgaagaaatcagggcactggttcaaggaattaagcgataataatggattttaaaaaaggactctgtctgattatcctaattggtcagagttttttggttataaaaagttaatttgaactataccaatttttactcttgacaagtgaaagaaacaagtatatactgtttttgctgattctataaaagaggaattagactataccaattttaaggagaaagcacagcttgtctgtgtcgtatatactatgtgtggaattgttggtgttgttggaaacacaaatgcaactgatattttgattcaagggcttgaaaagctcgaataccgtggctatgattctgcgggaatttttgttctaggtggtgctgaaaaccatctagtcaaggctgttggtcgtatagcagaattgtctgccaagacagctggtgttgagggaacaactggtatcggacatactcgttgggcaactcatgggaaaccaacggaagataatgctcacccacaccgctctgagacagaacgttttgttttggtgcacaatggggtgattgagaactaccttgaaatcaaggaagaataccttgcaggtcaccacttcaaagggcaaacagatacggaaatagccgttcacttgattggaaaatttgcggaagaagaaggtctctcagttcttgaagctttcaaaaaagctcttcatatcatacgtggttcttatgcttttgccttggttgactcacaagatcctgaagtcatctacgtagctaaaaataaatcaccacttttgattggtcttggagaaggctataacatggtctgctcagatgctatggctatgattcgtgagaccaaccaatacatggaaattcatgaccaagagttggtaatcgtcaaggctgatagtgtggaagttcaagattatgatggcaacagtcgtgaacgtgctagctatactgcggaacttgacttgtctgatatcggtaagggaacttatccttactacatgcttaaggaaatcgatgagcaaccaacggttatgcgtaaactcatccaagcctacacagatgaggctggtcaagttgtcgtagacccagctatcatccaggctgttcaagacgcagaccgtatctacatccttgcagctgggacatcttaccacgcaggatttgcttctaagaaaatgttggaagaattgacagatacaccagttgaacttggaatctcatctgagtggggctacggtatgccacttctcagcaagaaaccactcttcatctttatcagccaatctggtgaaacagcggatagtcgtcaggttttggttaaggctaatgaaatgggaatcccaagcttgacagtgacaaatgtcccaggttcaactctttcacgtgaagctaacaataccatgcttcttcatgcaggtcctgaaattgccgtggcatcaactaaggcttatacagcgcaaatcgcagcccttgccttccttgcaaaagcagtcggagaagcaaatggcaatgccaaagcgcaagcctttgacttggttcatgagttgtcaatcgtagctcagtctatcgaatcaactctttcagagaaagaaaccattgaagccaaggttcgtgagcttcttgaaacaactcgcaatgctttttatattgggcgtggtcaagattactacgtagccatggaagcaagtctcaaactcaaagaaatttcttacatccagtgtgaaggctttgcggcaggagagctcaagcacggaactattgccttgattgaagagggaacgcctgtcttggctctcttgtcagatccagtcctcgctaaccacactcgtggaaatatccaagaggtggcagctcgtggtgccaaagtcctcactatcgcagaagaaaatgttgctaaagagacagatgatattgtccttacgactgtacacccttacctctcaccaatttcaatggtcgtgccaacgcaattagtcgcttactttgcaacactccaccgtgggcttgatgtggacaaaccacgtaaccttgctaagtcagtaacggtagaataagcttaaaaagtctagttatctaggctttttcttgtgagcaaatcggttgcttgtactcaagattcgagttagaataatttttcaaaatgaaggaccggaatagacaaggagaatcactgtggtagaattgggaatttcaacatttggggaaacaacggagcttgaagggactgggaaaacttacagtcatgccgaacgcattcgtcagttggtggcagagattgagctggctgacaaggttggtttggatgtgtatgggattggtgagcaccatcgagcggattttgcgatatctgctccagagattgttctggcagctggggcagtcaataccaagaaaatccgtttgaccagtgcagtcagcattctctcaagtatggatccgattcgcttgttccaacagtatgccactattgatgctttgtctaatggacgtgcggagattatggccggaaggggttctttcacggaatcttttcccttgtttggatatgatttgaaagactacgaagccctttttgatgagaaattagacttgctccagttagttaatgaaaagaccaagttagactggcaaggtcgcttgacccaaacaatctctggcagagaagtttatcctcgtccagttcaggacaaattgcccttgtggatagcgacaggtggtcatgtcgaatcaacagtgaagattgctcaggcaggcctaccgattgtctatgccattattggtggcaatcctagttattttaaaaagttgattcaggcttatcgtgagattgggagcgaagcgggtcatgccagtcatgaactaaaggttggagcccattcttggagctggattgctgaagatggcgagcaggcggtgaaagattattttcatccgaccaagcaagtggtggatgctatttccaaagaccgtccacactggcagggattgcgttatgagcaatatttggagcaagttgggccaaatggtgctatgtttgtgggcaatccagatcaggtagcagaaaaattgattcgcatgattgaagacttaggtttggaccgctttatgttgcacttacctcttggttctatgcctcatgatcaagttctaagagctattaaacttttcggaacgcaagtggctccaaaagttcgagcttactttgccatgaaagaggcttaataaaaactactcaaatttattatgacgataaatattgtacaaaaatcaatcccccgagcgtcaaggcttgggggatttttctataggagggctagtttagttctcttttttgttttttagtaagaacccgagacctagaagggcaagaatgctgattcctgcaaacaggagtttgtgatcgtttttggttcctgtatttggaagttcagcttgtttagctaggggtgcagctatattttccttgctagagttatctaccgattcgttttgaacagcttcacttacagatgatgcttgtgcttcttgtgctggttgttcagcttgtgaatcagctgtagcttggctaggtttattttctgcatcagctacttttgcatctggttttgcagaatcaggtttagtttgtggagctggagtttgctgttccggtttgactactcggtttgacatattgtcttggatattatattgcccttgttcttgttttaagctagaaaggtcaaattctggtttttcttccacagctggggcaacgatggcaccgccttgagagattctaagaacagtagctgtaagggcatttaatttcaagcctttttcagtccattcgagtcctttcgggttggcaattcctactggccctgcttggttttcatctgctaaaacttcagcatttctgaggtgggcaaaggcagttcccaaattaaattcgcgagctttttcgtccgcattgacaaagactgcgtagatgtctccatttggagcagtgatttggtagccaattactacgtcctcttttgccacaccattttggcctgggacagtgatgaggtggacacggtctttgatatcttggagactcttaagtcggaaggcatctgtagattgacgaagagcaatcaaccctttcatatagtcacggctcttgacattttcaggatatgcttttccatctgtagccttagtccagtcaaacttgttaatagcatcactcgaatcgtaagagtcatggatgaagtaaggatagtcaaatggattgccgtccttatcacgcaacaagtgagatttgtttggaaccttatcctccgatactggagtcttgtaggctgggtcacggaattgtttagtacgtccgtattcctgaccagagtggataaacggagttccttgagatgtcaagaccatgaggtttccaagtcgcaaacgacggtggatttcagcatagttctcagccttgcttgggtcttttttgatagactgggcgatgatgtcaaagagggtcaagttatcatgggctgcgatgtattggatgacatctccagggctgtcagcttcaaagttggttggttgagcaatgatatttttgaagatggtgttgatatcacgcttgccacctgtgataaaggcaggttgaccttcgtttggataaccagacttgaggttgttacgaatgtcatctgaaaagacagcgactgtatcggtatgtttcatccaatcttggtcagcagctttagtaggcatgttctcatcacctgcataggttctccaaccttcaccaagcatgattaagtgtggattgagggcgcgtgcggccttgtacgcttcttcaatagaagctgcatcatggtctcccatcatatcgaagcggaatccatccactttgtaggtatcaactagatatttgatagagtcaactaggagtcgtttggtcatatggtgggttgtccccaagcgtccaccaccaaagctagtgcgaggtgtcccatcagcatccataaagtggtagtagtttggctctaaatcttcaaagatatcgaccttggctgtatggttatacactacatctaggatagctcccataccacgtttgtggatctcgttgatgaggtttttaaattctgcgattcgtttttctggatttttaggatcgcttgaatacataccagtcaaggagaagtagttttgaggatcatatccccagttatagttgctgttgcttgaagcatagtcagacaagcgttcatggtttttcaattcattgacaaagtagtaagacaagactggaaggagctggatgtgggttacacccaagtctttgagatagtctagtttttcaataaatgcttcaaaggtaccaaatggtttggttaagtcttttgcaatggcaggatctgaagtaaagtcacgcacatgagcttcgtagataacggcatcttcacgagtcttgaaattgtgaatcttaccataagtcaagtcttgaggtccgagtttggctggatctacaaaggcggctttagccactttatgggcatcgtcaatcttagcatcgtcactattccaagcagcgagggacttagcgtaaggatcgagtgcaagaacagttttaccttgacgttcgatttggtattgataatagtatccagtgaaatctgtgattccgagtttgtttgtgctatctagagtttgtttccaagttcctctttcccctttttcaagagcgacagttccaaccactttttcagggttattcttgtcgtagacaacgacagaaaccttgtcagcacttggtgaccaaagggttaaatcaacttgttttccttcttcttttaggtcagctccaagtttgccatcataactgtaagtctcatctttcagacgccagcttgttttggtagtgaattggtcagcgttgtagctcacggtataaggatgttttgtgtccgagaaatctccactgtaggtcactttcttaccagcttcatcgattgcaacatcggtgatagctactttatttcctaggtgattagtgatgttggagtgtttgaggatatcctcttttttagcaccgacaagtgttgaaaaactactctcaatgctagaagtgcctacgtgttgggctcctgtcatacggatatcatggacatagtatggatttgtgtaaatcgattcatcatcgtcttttaggaaaatttggctatgattttttaaatctgtgaacttataatcttctttacggattttcacatcgtctccttgtttgtttctgtctagtaataaaaatccaaggtctttagctgcatctttgagtggaatatcgatatagcgaccatatttgcctgtagccgtaaaatctgttccgttaggccattcaccactacttggatttttcacatctccccagtaccagagagatttcttgtcatagttgccatctgtacggtagtagttgacgcgaatagttcctgcaggttgtggctcgtaagagaaaaccttgtgttcttggtccaaccaagcctcattcatatttggtgccagtttttctatcgatttatcgccggttagatttttcccagctgtattattgatgaggaagctaattttcttggcttgttctccctttaatttgacatctaggtagtagccatagtcatcttttttggcatccttaaaggacaaggctccgttaggccagttttcagatggtttttcaacatcgtcccaagtccatagtccttgagcatccttgttttcttcaggaagctttttgacatggatacggaagtagttgtcttctattggttcttctgccttagtttcagtcgttactggactcgtagaagtagttggttcacttgaacgatcttgtccggtttgtggggctgaatcggcgggagttgcagcaggagtagttggctctgttgcaggtttttcttctgttttctttagggaagcgtttgcactatcgggtgaagaaaaatcgctttcgttcttgccagcgatgtttgttgcatcagtaagaggttgagtaagggaggtcgtatttctgttgctgggttcgttagtggttggtgtattttcgtttgctgagatagttggtgtagccatggcaagcagaataaggcttgctccaataaggacagaaccagttccatttttgagggaacggatgctgtagaccatttttttctcagtttgagatggtatttttctcataatgattctccaatcaataaatttctatcatcagtatagcacttagtaaaataagatgcaagcgttttcctaaaattaaaataaaagaaaaaatcgcaacaaattttgttacgattaagccagtatttcttataggaaaagattttgtcaaaaaattgttaatccccttgaaaaatctagctaaatagggtataatatgagtaatcatttgtcgtaggttttgtctgaaatattgtccagacaaggctcacagcagttaaatcttctgaaaaagtcagatttagctgctctttttgtgctttttttcaggatttttagtacttgtaacaaagacttaaagattctgaaaatttatcaagaggacacggtgataagggtttttaaaaccatatgacgattagaaaagcctgattgacaaggcttggaacttatttacaaaggagaatcatcttggcaggacatgacgttcaatacgggaaacatcgtacccgtcgtagtttttcaagaatcaaagaagttcttgacttaccaaatttgattgaaattcaaactgactcattcaaagatttcctagaccacggtctgaaggaagtatttgaagatgtattgccaatttcaaacttcacagacacaatggagttggaatttgttggatatgaaatcaaggaaccaaaatacacgctagaagaagctcgtatccacgatgctagctattcagcaccaatttttgtaaccttccgcttgatcaataaagaaacaggcgaaatcaagacccaagaagttttctttggtgatttcccaatcatgacagaaatgggtactttcatcatcaatggtggtgaacgtattatcgtttcgcagttggtccgctcaccaggtgtttactttaacgataaagttgataaaaacggtaaagtgggctacggttcaactgttatccctaaccgtggagcttggttggagcttgaaagcgactcaaaagacatcgcctacactcgtattgaccgtactcgtaagattccatttacaaccttggttcgtgcccttggtttctcaggagatgatgaaatctttgatatcttcggcgacagcgaattggttcgcaacactgttgaaaaagatatccacaagaatccaatggactctcgtacagacgaagccctgaaagaaatttacgaacgccttcgtccaggtgagcctaagactgctgaaagctcacgtagcttgcttgtggctcgtttctttgacccacgccgctatgacttggcagcagttggtcgttacaaaatcaataaaaaactcaatgtcaaaacacgcttgctcaaccaaaccattgcggaaccattggtagaccctgaaactggagaaattttggtagaagctggtacaatcatgactcgtagcgtgattgaaagcattgaaagccatttggatggcgacttgaacaagattgtttacattccaaatgatgcagcggttgtgactgagccagttgttcttcaaaaattcaaggttgttgctccaactgatccagaccgcgtcgtaactattattggtaatgccaatccagatgacaaggttcgtatcgtcactcctgcagatatccttgctgaaatgagctacttcctcaatttggctgaaggacttggtcgtgtagatgatatcgaccaccttggaaaccgtcgtatccgtgcggtaggtgaattgcttgctaaccaagtacgtcttggactttctcgtatggaacgtaatgtccgtgaacggatgtctgtccaggacaacgaagtcttgacaccacaacaaattatcaatatccgtcctgtaacagctgcggttaaagaattctttggttcatcacagttgtcacagttcatggaccaacacaacccactttctgagttgtctcacaaacgccgtttgtcagccttggggcctggtggtttgacacgtgaccgtgctggatatgaagtacgtgacgtgcactacactcactacggtcgtatgtgtccaatcgagacacctgaaggacctaacatcggtttgatcaataacttgtcatcttacggacacttgaacaaatatggttttgttcaaacaccataccgtaaagttgaccgtgaaacaggtgttgttacgaacgaaatcgtttggttgacagccgatgaagaagatgaatttactgtagcacaggctaattctcgtctgaatgaagatggaacatttgctgagaaagttgtcatgggacgtcaccaaggggtcaaccaagagtatccagcgaatgttgttgactacatggacgtatcaccaaaacaggtagttgccgttgcgacagcatgtattcctttcttggaaaacgatgactccaaccgtgccctcatgggagccaacatgcaacgtcaggctgtaccattgattaatcctaaagcaccttacgttggtactggtatggaataccaagcagcccacgattcaggagcggctgtgattgctcagtatgacggtaaagttacctatgcagatgctgacaaggtagaagttcgtcgtgaagatggttcattggacgtttaccacatccaaaaattccgtcgttcgaactcaggtactgcttataaccaacgcactctcgtaaaagttggtgatgccgttgagaaaggcgatttcatcgctgacggaccttctatggaaaatggagaaatggcgcttggacaaaacccaatcgttgcctacatgacttgggaaggttacaacttcgaggatgccgttatcatgagcgaacgcttggtgaaagacgatgtctacacatctgtccaccttgaagaatacgaatcagaaacacgcgatacaaagcttgggcctgaagaaattactcgtgaaattccaaacgttggggaagatgcccttaaagatcttgacgaaatgggtattatccgtatcggtgctgaggttaaagaaggggatatccttgtaggtaaagtaacacctaagggtgagaaagacctttcagctgaagaacggctcttgcacgctatcttcggagataaatctcgtgaagtacgtgacacttctcttcgtgtaccacacggagctgatggtgtggttcgtgatgttaagatctttacacgtgcaaatggagatgaattgcaatcaggtgtcaacatgctggttcgcgtctacatcgctcaaaaacgtaagatcaaggtcggagataagatggccggacgtcacggaaataaaggggttgtctctcgtatcgttcctgtagaagatatgccttaccttccagatggaactccagtcgatatcatgttgaacccacttggggtgccatcacgtatgaatatcggtcaggttatggaactccaccttgggatggcagctcgtactcttggtattcacatcgcaacaccagtctttgacggagcaagttctgaagatctttggtcaactgttaaagaagctggtatggatagcgatgccaaaacaatcctttacgatggacgtacaggtgaaccatttgataaccgtgtttctgtcggagtcatgtacatgatcaaactccaccacatggttgatgataaattgcacgcgcgttcagtcggaccttactcaaccgttactcaacaaccacttggaggtaaagctcagtttggtggacaacgtttcggtgagatggaggtttgggctcttgaagcctacggtgcatcaaatgtccttcaagaaatcttgacttacaagtctgacgatatcaacggacgtttgaaagcttatgaagctattacaaaaggaaaaccaattccaaaaccaggtgttccagaatccttccgagttcttgtcaaagaattgcaatctcttggtcttgacatgcgagtccttgacgaagatgatcaagaagtggaacttcgtgacttggatgaaggaatggacgaagatgtcatccacgtagatgaccttgaaaaagcccgcgaaaaagcagcacaagaggctaaagcagcctttgaagctgaagaagctgagaaagcaacaaaagcggaagcaacagaagaaactgctgaataagaataagcagttcacttagaatagaaagggaagaaatagtggttgatgtaaatcgttttaaaagtatgcaaatcaccctagcttctccaagcaaagtccgttcatggtcttatggagaagtcaaaaaacctgaaacaatcaattaccgtaccttgaaaccagaacgtgaaggactatttgatgaagttatctttggtcctacaaaagactgggaatgtgcttgtggtaagtacaaacgcattcgttacagaggaattgtttgtgaccgttgtggggttgaagtaacgcgtacaaaagttcgtcgtgagcgtatggggcacattgagttgaaagctcctgtatctcacatctggtacttcaaggggattccaagccgtatgggcttgacccttgatatgagccctcgtgccctcgaggaagttatctactttgcagcttatgtggtgattgatcctaaggatacaccacttgagcacaagtctatcatgacagagcgcgaataccgtgagcgcttgcgtgagtatggttatggatcattcgttgccaagatgggtgccgaagctatccaagaccttctaaaacaagtagatcttgaaaaagaaattgctgaactcaaagaagagttgaaaacagctactggacaaaaacgtgtcaaagctatccgtcgtttggatgttttggatgccttttacaagtctggaaacaaacctgaatggatgattctcaacatccttccggttattccaccagatcttcgtccaatgttgcagttggatggtggccgttttgcctcatctgacttgaatgacctttaccgccgtgttatcaaccgtaacaaccgtttggctcgtttgcttgagttgaatgcaccaggtattattgttcaaaatgagaagcgtatgcttcaagaagcggttgacgctttgattgacaatggtcgtcgtggtcgtccaatcacaggaccaggtagccgtccattgaaatcattgagccatatgcttaaaggtaaacaaggacgcttccgtcaaaacttgctcggtaaacgtgttgacttctcaggacgttccgttatcgccgttggtccaacgcttaagatgtaccaatgtggtgtgccacgtgaaatggcgattgagctctttaaaccattcgttatgcgagaaatcgttgcacgtgatatcgtgcaaaacgtcaaagcggctaaacgcttggtggaacgtggagacgagcgtatctgggatatccttgaagaagtaatcaaagaacacccagtacttcttaaccgcgcaccgacccttcaccgtttgggtatccaagccttcgagccagtcttgattgatggtaaggcccttcgcttgcacccacttgtctgtgaagcctacaatgccgactttgacggggaccaaatggccatccacgtaccgctttcagaagaagcccaagcagaagctcgtatcctcatgctcgctgctgagcacatcttgaacccgaaagatggtaaaccagttgttaccccatctcaggatatggttttgggtaactactacttgactatggaagaagctggccgtgaaggtgaaggaatggtcttcaaagaccgtgacgaagccgttatggcttaccgtaatggttatgttcacctccactcacgtgttggtatcgcaacagacagcctcaacaaaccatggacagaagagcaaagacacaaggtcttgcttacaacagttggtaaaatcctcttcaacgacatcatgccagagggtctaccatacttgcaagaaccaaacaatgccaacttgacagaaggcgttccagctaaatacttcttgccacttggtggagatatcaaggaagcaatcagcaaacttgaactcaaccctccattcaagaagaaaaaccttggaaatatcatcgctgaaatcttcaaacgtttccgtacaacagaaacttctgctctacttgaccgtatgaagaacctcggttaccaccactcaactcttgcaggattgacagttggtattgccgatatcccagtcgttgatgacaaggctgaaatcattgaagaatcacacaaacgtgtagaacaaatcacaaaacagttccgtcgtggtatgatcacagacgacgagcgttacaatgctgttacagctgaatggcgtgctgcccgtgagaaactagagaaacgtttgattgccaaccaagatcctaagaacccaatcgttatgatgatggactctggagcccgtggtaatatctcaaacttctcacagcttgccggtatgcgtggtctgatggctgctcctaacggacgtatcatggaattgccaatcctttcaaacttccgcgaaggtttgtcagtactcgaaatgttcttctcaactcacggtgcccgtaaaggtatgaccgatacggcccttaagacagctgactcaggttacttgactcgtcgtttggttgacgttgcccaagacgttatcatccgtgaggacgactgtggaacagaccgtggtctcttgatccgttctatcgcagaaggaaaagagatgatcgagtctcttgaagaacgtctcaatggtcgttacactaagaaaaccgttaaacatccagaaactggtgcagtgattatcggttcaaatgagttgattacagaagacaaggcgcgtgaaattgttaatgctggtgtggaagaagtgactatccgctctgtatttacatgtaacactcgtcatggtgtctgtcgtcactgttacggtatcaacttggcgactggtgatgcggttgaagttggtgaagcagttggtacaatcgctgcccaatctatcggggaacctggtacacagcttacaatgcgtaccttccacacgggtggggttgcctcaaataccgatatcactcagggtcttcctcgtgtccaagaaatctttgaagcccgcaatcctaaaggggaagcggttatcacagaggttaaaggacaagttactgctatcgaagaagatgcatcaactcgtactaagaaagtctttgttaagggtgaaactggcgaaggtgaatacgtcgttccatttacagctcgtatgcgtgttgaagttggagaccaagtagcgcgtggtgctgctcttacagaaggttctatccaaccaaaacgtctccttgcagttcgtgatgtcttgtcagttgaaacttaccttctcggtgaagtacaaaaagtttaccgtagccaaggggtagaaatcggtgacaaacatatcgaggtaatggttcgtcaaatgatccgtaaagtccgtgtcatggatccaggtgacacagatcttctcatgggtaccctcatggatatcaatgactttacagatgccaacaaagatgtccttattgcaggtggagttccagcgacaggtcgcccagttcttatgggaattaccaaagcctcacttgaaacaaatagtttcttgtcagcggcttccttccaggaaacaactcgtgtccttactgatgcggctatccgtggtaagaaagaccatctccttggacttaaggaaaatgttatcatcggtaagatcatcccagctggtactggtatggcccgttaccgtaaccttgaaccacatgctatcaacgaagaagaataccttaatcctccagtagaggaagaaggggatgaagaaataacagaagtagttgtggatactgccgttgaaactgtggaagaaacagtagaataaaagagaatgagagagccttcgggttctctttctcttttctgaaaactttctccatttttccatgaaatgtggtaaaataatactcaatgaaaatcaaagagcaaactaggaaactagccgtaggttgctcaaagcactgctttgaggttgtagatagaactgacgaagtcagctcaaaacactgttttgaggttgtggatagaactgacgaagtcagtaaccatacctacggtaaggcgacgttgacgtggtttgaagagattttcgaagagtataaaagaaagaagctgacaaaggagacaggtatggaacaaacattttttatcattaaaccagacggtgtaaaaagaggattagtgggtgaggtgttgaaacgcatcgaacaacgtggatttacaatcgaaaaattggagttgcgtacaaaggtttcagaagggttaattgatcagcactatcaggacttggttggtcaaagtttttacccaccgattcgtgaatttatgacttcaggaccggttcttgtaggtatcatttctggtcccaaagtaattgaaacttggcggactatgatgggtgcaactcgtccagaagaagctttaccaggaactattcgaggtgattttgcaaaagctgctggagaaaatgaggttatccaaaatgttgtgcatggttcagattcagaagagtcagctaagcgagaaattgctctttggtttgaagagaaatagtaaaagtttgatgtaagggatacttgcgtcaaacttttttgcattttagagtagaaaactgacagttgagaaatattctagcaatggtgaggctttctagcatataataagagcaagtatggaggaagaatgatggaaaaaatgaaaaagcaaattcgagttttgttattgctgacagtttttggtcttagcagctgttcttgtttaagtttatctacttgggccttgatgttaaatcaaaactgcttctattatttagttggcatgttgcttcttgccagtattggtgcagggctaaactattatagagggcagggaaatcaacattattcagtttttaaggaagataagcaacaattcttgtatagtctcttgctcttagtaaatattttgggtttagctttaattgtcatagaacatatccttgcaggaaatacatccgtagaaggatttgtggaagcctttctaccgagtttctttttcttatttgggattgatttgttagtttttctgccgattcagaagtatgtaaatggagtgaaaaagtttttgggaaagaaggaaatctgttttattagtggactagctattctaatctttctcagaaatccttggatgctattgtccatgaccttttatattgccttggggatgctatttctaggactgttggtgccaaaagtcattcgctgggaagtttcattttacagtcatttgatgagagatatcttgttagttgtcttcttactgtttctattttaagaacaaaaaaagagatagttctagttttacaatttataatatggaattcatagataatacctagacaaaggacaactttttggtataatagaaacatgtacactaaaaacgaagaagagttacagtccttaggtgaacgtttgggctatttattagaaaagaatgatgtcttaattttaactggtgaacttggagcaggcaaaacgacatttacaaaaggtcttgctaaaggattacatatttctcagatgattaagagtccaacctacactatcgtaagagagtatgaaggtcgtcttccactttaccacctagatgtttatcgtatagagggggatgctgattctattgatttagatgagtttctctttggtggtggggtaactgtcatcgagtgggggcatcttttaggtgatgccttgccagatacttatttagaattggaaattctaaaagaagaagagggtcgcagactgaattttcaagcaaaaggtttgcgtgcagaaaagcttttagaggagcttcaacatggagtatgagttgctcattagggaagcagaagttgaagatgcggctgaattagtatcatttttaaatcgtgtcagtgtagaaacagattttaccagtctggacaggaatggcattttgatgacagatactgagatggagttgtttttggataaacaggctcactctgaaaatcaaatcactttactggccttgctgaatgatgaaattgctggtcttgtgaatatcacagctgatcaacgcaagagagttcgtcatattggagatctctttattgtgattggtcagaagtattggaataatggactggggagtttgttacttgaagaagtcgtagaatgggcacaggctagtggcattcttcgtcgacttcaactaactgtccaaactcgcaatcagggtgcagttcatttatatcaacagcatggctttgtaattgaaggtagacaagagcgcggtgcgtacatagaagaagggaaatttatagatgtttacctgatgggtagactgatagattgatagaaatatggttaaaaaaattattggaatggtgctagcttttctagctgtgacagttttaggtgtgggtgtttttgcttatactatttatcagcaaggtacagaaaccttatcaaaaacctataaaaagattggggaagaaaccaatgttattgaggctactgaacccttaacgatccttttaatgggggttgatactggaaacgaagaacgaacggacccttgggagggaaatagtgattccatgattcttttgacagttaatccgcacacgaaaaagaccatgatgttgagtttggaacgtgatatcctgactaaaattcagcataaagatggtagtattgaagaagcgaaactgaatgccgcctatgcgggtggaggtgcagaattagctatctcaaccattcagaagatgatgaacatccatattgaccgctatattatggtcaatatgcacggattacaacaattagtcgatgcagtgggtggtataactgtcaataacacgctaggtttcccgatttctattagtgaccaagaggaatttaatactatttctattggtgttgggcaacaaactctaaatggagatgaagctcttgtttattctcgcatgcgctaccaggacccagaaggggactacggacgtcagaaacgtcagcgtgaagtcattcaaaaggttgttgaaaaagttcttagcttgaatagtgttagtcactatcaatctatcttaaaagccctaagtaccaatatgcagactaatattgatctatctgctaagagtatcccaagtttgttaggttacaaggactcgtttaaaacgattgaaacccaacaattacgaggagaagatgccgaattgcaagggacatcttaccaaatcgtaactgctaaccatttgttagagatccagaatcttttgagaacctcacttgataaaccgagggtgacagagttagagacaaatgcagtcttatatgaagatatttttggaaaccaaaatggtatcggtttgggaacaggtacgattaataatacaacaaatcaagaagatgtagaataatctattttatagttaaaatcgtgggaaatttcctacgattttttcaaaaaaatacgaatagatagttaggaggaaacatgaaagcagaaattattgctgttggaacagagattttgacaggacagattgtcaataccaatgctcagtttttgtcggaaaaactagcagagattggggtagatgtatattttcagacggctgtaggagacaatgaagctcgtctcttgtctttgctcgaaattgccagtcaacgtagtagtctagtgattttgacaggtggtttagggccaactgaggacgatttgaccaaacaaactctggctaaatttttagggaaagaattagtctttgatcctcaggcgcaggagaagttggatgtcttttttgcccagagaccagactatgcccgaacaccgaataacgaaagacaagctcaacttgtagaaggagcgattccactgccaaatgaaacaggactggctgtgggaggaatattggaagtcgatggagtgacctacgttgtccttccaggtccaccaagtgaattaaaacctatggttttaaaccaacttctacccaagttgatgacagggagcaagctgcattcccgagttcttcgtttctttgggattggcgagagccagttggttacgattttgtctgatttgattgataatcaaaccgatccgaccttggccccttatgctaagacaggagaagtcactctgcgtctgtcaacaaaagctagcagccaagaagaggcgaatcaagtgctggatatcttggaaaatcaaatcttaggtcgccagacctttgaaggcctttctttacgagatctttgttatggttatggggaagaaactagtttagctagcattgtggtagaagaactgaaaaggcaagggaaaaccatcacgtctgctgagagtttgacggctggtcttttccaagctagggtagcggatttttcgggtgcttcaagtatatttaagggtggttttgtaacctatagcttggaggaaaaatcaaagatgttggatattcctgtcaaggatttggaagaacagggtgtggtgtctgaatttacagcacagaagatggctgagcaggcacgaatcaagacccagtctgattttggccttagtttgactggtgtggcagggccagatagcctagaaggacatccagctgggacagtcttcataggcttggctcaagagcaaggaactgaggtcatcaaggtcaatattggaggcagaagtcgagcagatgtacgtcacattgcggttatgcatgcctttaacctagttcgcaaggctttattaagtgactaacttttgatataatagtagataggtctgaggaccattagaatgtaggagaatagaatggcgaaaaaaccaaaaaaattagatgaaatttcaaaaaaaattcggggcagaacgtgaaaaagccttgaatgacgctcttaaattgattgagaaagactttggtaagggttcaatcatgcgtttgggtgaacgtgcggagcaaaaggtgcaagtgatgagctcaggttctttggctcttgacattgcccttggttcaggtggttatcctaagggacgtatcattgaaatctatgggccagagtcatctggtaagacaacggttgcccttcatgcagttgcgcaagcacaaaaagaaggtggtattgctgcctttatcgatgcggaacatgcccttgatccagcttatgctgcggcccttggtgtcaacattgacgaattgctcttgtcacaaccagactcaggagagcaaggtcttgagattgcaggaaaattgattgactcaggagccgtggatcttgtcgtagtcgactcagttgcggcccttgtccctcgtgcggaaattgatggagatatcggtgatagccacgttggtttgcaggctcgtatgatgagccaggctatgcgtaaacttggtgcttctatcaataaaaccaaaacaattgccatctttatcaaccaattgcgtgaaaaagttggggtcatgtttggaaatccagaaacaactcctggtggacgtgctctgaaattctacgcatcagtccgtttggatgttcgtggaagcacacaaatcaagggaactggtgaccaaaaagataccaatgtcggtaaagaaactaaaatcaaggtcgtgaaaaacaaggtggctccaccatttaaggaagccttcgttgaaatcatgtacggagaaggtatttctaagactggtgaactcttgaaaatcgcaagcgatttggatatcatcaaaaaagcaggagcttggtactcttacaaggatgagaaaatcgggcaaggttctgaaaatgctaagaaatacttggcagataacccagaaatctttgatgaaattgaccatcaagtccgtgttcaatttggtttgattgatggagaagaaattgctgaaagcaaaaaagatgaagcagctcaagtagactctgtgaatgaagaagtaacccttgacctaggcgatgagcttgaaatcgaaattgaagaataagttgttaaagtagtggagcaaatccactgctttttcgatgccttattctggttttccgctcacgcatagtttgctgtttcttgtcgctcctctggaaagctgatataatagccttatgaataaaaaacgaacagtggacctgatacatggtccgattcttccttctctcttgagttttgccttcccaatcttgctatcaaatatttttcaacagctctataatactgctgatgtcttgattgttgggcgttttcttggtcaagaatccttggctgcagtaggagcgacgacagcaatttttgacctgattgtaggatttactcttggtgttggcaatggcatgggaattgtcattgcccgttattacggggctcggaattttataaaaattaaggaagcagtagcagccacctggattttaggtgctcttttgagtattgtagttatgctgctgggatttcttggtttgtatcctctcttgcaatacctagatactcctgcagaaattcttccccagtcctatcaatatatttctatgattgtgacctgtgtcggtgtcagctttgcctataatctctttgcaggtttgttgcggtccattggggacagtctggcagcgcttggatttctgattttctctgctctggttaatgtggttctggatctctatttcattacgcaattgcatctgggagttcaatctgcaggccttgctaccatcatttcgcaaggcttatcagcggttctctgcttttattatatccgtaagagtgtgccagaacttttgcctcaactcaagcatttcaaatggaacaaggctttgtacgctgatctcttggagcaaggtttagctatgggtttgatgagttcaattgtatcgatcggcagtgtgattttacagtcttctgttaatacctttggtgcagtgattattagtgcccagacggcagctcgacgcattatggctttcgcccttcttcccatgactgctatttctgcatcaatgacgacctttgcttctcagaatctaggagctaagcgaccagaccgcattgttcaaggacttcgaatcggcagtcgtctaagtatatcctgggcagtttttgtttgtatcttcctcttttttgccagtccaaccttggtttccttcttggctagttcgacaaatggttacttgatagaaaatggaagtctgtacttgcaaatcagttcagccttttatcctattttgagtctcttgttgatttatcgcaattgtttgcagggtttggggcaaaaaatccttcctctggtttctagctttatcgaactaatcgggaaaatcgcttttgtggttttgattatcccttgggcaggatataagggagttatcctttgcgaacccttaatctgggttgccatgaccattcaactgtatttctcactgtttcgtcaccccttgataaaagaaggcaaggaaattttagcaactaaagtgctatcctagttgtatttactgaataaaatccatttcctctagtgaaaatcgaaaaaacttgtgttataataagaaagattaaaatgtgaaaaaaggagattcctaatgggacgtaaatgggccaatatcgtagccaagaaaacggctaaagatggagctaactctaaagtatatgcaaaatttggtgtagaaatctatgtagcagctaaaaaaggtgatccagatccagaatcaaactcagccttgaaattcgttatcgaccgtgctaaacaagcccaagtgccaaaacacgttatcgataaagctttggacaaggctaaaggaaacacagacgaaacctttacagaaggacgttacgaaggttttggaccaaatggttctatgctgattgttgatactttgacttcaaatgtcaaccgtacagcggctaatgtccgtgcagcctttggtaaaaatggcggaaacatgggcgcttcaggttcagtttcatacctctttgacaacaagggagttatcgtatttgcaggtgaagatgcggacgcggtctttgagcaattgctagaagcagatgtggatgtggatgatgtagaagcagaagaagggacaatcacagtttacacagctccaactgaccttcataaggctatcgttgcccttcgtgagtcaggtatcgaagaattccaagtgactgaattggaaatgattcctcagtcagaagtggaattgtcaggcgatgatcttgaaacctttgaaaaactttacagcgttcttgaagacgacgaagacgtacaaaagatctacacaaacgtagatggattctaatagaaaaacgaacagttttactagctgttcgtttttttgatatttgaacttagaatctggtttcagaatcgttttgttgattgctttttctagacctagaccgactgatgtttttggacgagcaagagctctccattgtcctgttttgcaaaagttaaggtaacagtcttgatcttgtctccaatagagatataggtgatttttttcgtattgtaacccccaagagtgaagtcaaactcggaatctggctttccgtgtttgttgataatatcctcgtaggtggtaccaccttttcctttgttgtcaaggtcaccttcgattaaggcgtcgaactgttcttgggtccaggagaaggtatcgtctgtcaagccgcttttttcttcgcgttccattgaggcactcgtatccatgtaggaacggttaaactccttggcatactctttgtagacatcagcgtatagtacctgagtcgtaaagaaaagtacaacagaggcaactgccagggatgttccgataatagtcattgttttccgttttttgaggttgacgataaggccgataatccccaagataaatgcgacgatgccgatgaacaacgatggatagttaataaacgggatccaggatcctaaaagtgcgatggctccaaaaatagttgctaagattcctaaaactctttgttcttctggtttcatttgaaagttttctctcctcattaagtgaatggatttctacccacagtagtgagcgcttattatataaaaaatcttgcctaatgtcaatttaaactaagatagttctcatggaaactttttcttgacatctctttttaaagtggtaaaatagttctcatggaaacttatttagttcctaggagaactaaatgtgatagttagaaaggagttagtatggataaaccgatgttagtctttaagcgttttggtcatcagattcacctgatggtgcaaaaggaagccaaacgttgtggtattgaatttatgggtgggcctcaagggcaggttctgcattttttagatcattgtgaacaaaaagaggaactggtcctgattaaggatatcgagcaggaactcaatattaccaagtctgttgctagtaatttggtcaagcgtatggtgcaaaatggtttggtggaattggaggcgagtcctagcgataagcgggcaaaatttgttcgtttgacggacaaagcacgttctcagatgcaacaggttaagtctttttttgaacgaatagacaagaagttgatggaagacattgatgaagatgaattactgatttttgagaaagttctcggtcaactacaggaaaatatcaagagaataggaggagataatgaagaaattagctaaacgaattagtagaaaagaatgggggatgattttactagccattctctttacctgcttttcagtctacctagagttggaagttccgacctatatctcgaaaattacggatttgctgggaagtcaaggaaccaacttggatgagttatggcaaccagcaggtatgatggtcggaatgtctttttttgccttcttatccgcagtcgcagttggattttttgcatcccgagtggcggcttcttatactagtaggctgagaagtgatatttttaaccgagttttggattactcgcagacagagattaagagattctctattcccagtcttttaactcgtaccaccaatgacattactcaagttcagatgttgattaccatgggcttgcaagtagttacgcgtggtccgattatggctatctgggctatcgggaagattttaggtcattcagaatactggctctgggccgtacttgtggcagtgattgtcaacgttctgatgacgactgttttgatgacgctagcctttccaaaacagtccttgattcaggggctgactgataaactgaacagtatcactcgtgagagtttaacaggtattcgcgtcgttcgcgcctacaatgctgaagaataccaaaatgaaaaatttgcagcagcaaatgatgaattgacacgcttgaatttgtttgtcaaccgtcttatggctattttgaaccctatcatgatgggaatttcaagtggtttgagtgtggcgatttactggattggggcctatgtgattaacgacgctgctccgatagcacgtctgcctctctttagtgatatgattgttttcatgtcttatgccatgcaggttgtcatgggcttccttctcatgggagcactcttcatcgttcttccccgaactatagtctctgctaagcgcattaatcaagttttagatttgcattcttctatccaaaaccctgctcaagtgcagctggctgatgaaaacctcaaaggtcaggtcgaatttaaggatgtgaccttccgctatgcggcaaattcggaggcagttatcgagcatgttagctttagagcagaaactggtcaaacagtggcctttattgggtcaacaggttctggtaaatcaactctagtcaatctgattccacgtttctacgatgtgtcagaaggagaaattctggtggacggtgtcaatgttcaagactatgctctagaagatttgcgcaacaaagttggttatattcctcagaaagcggttctcttttcaggtgatgtcaagggcaatctagactttggacaaagtctagaaacaccgcttagtgagcaggctatgtggcaggctttggagttggcccagtctaagaactttatcgaagacaaggaagcgggcttagcgtcagaagtgtcccaaggaggaaccaacttctcaggtggtcaaagacagcgtctagcaattgcgcgtgccttagctcggaagccagaaatcctcatctttgacgactccttctcagccttggactacaagacagaccgtgtcctacgccaagagttagtagagaaaaccaagtctatgaccaagcttattgtcgcacagcgtatttcaacgattatggatgcagatttgattttggtcttggatcaaggaaaagtcgtgggacaaggcacccacaaggaacttctagctaataatgaagtttaccaagaaattgcctattcacaactatcgaaggaggaattggaacatggaaaataagaaaatgtctctttggaaacagagcaaaccctatcttgcaggcctccagtttgcccttctgatagcctttctagcaacaatcgtatccaatatcattactgtatatggtccaacccgcatcaaggaaatgactaatattattgctagtggtctggaaacaagtgtggatgtcgtggcggttgcagctattggtggttttttggccgtgatttatgtgataggacttctatcaaattatttacaggcatttctgtttacaacagctattcaacgtttttcagagcgtttgagaagagctattgcagagaaaatcaatagcctaccattgggatattttgatggacattctcaaggagataccttgtctcgtgtgaccaatgatgttgatactgcagcccagtccctcaatcaaagtctgggaacagttctttcatccactttactggtcgtggcagtcttggtaaccatgtttgggatgaactggattttagccttggtgacggttgtttcaactcttgttggttttgttttcgtgtccgtctttatgggcaaatcacagggcttttttaagagtcagcaacaagatttggcagctgtcaatggctatgtggaggaaatgtactctggccataatgtggtgaccagttacaatgctatcgagagcacgaaagaagagtttgcgaaattaaacaatcgtctgtatgatagtatctggaaatctcaatttatttcagggattatgatgccgattatgatgtttattgggaattttagctatgccttggtgattatcgttggtgcagccttggccttaaatgggcacatcagtatcgggattatcgttgcctttatggcctacgttcgtatcttttctcagcccctttcacaaattgcccaaggggttactagtcttcagcaggctagtgcagccatgggacgtgtcttcgaattcctagctgaagaggaaatggaagacgaatcccataaagaaagacaattgagcgatatgaaaggtcaagtagtctttgatcgagtctcctttggttatacaccagagcgaaccattattcatgacttttctgcgaccgctcatgcaggtcaaaaggttgccattgtcggaccgactggggctggtaagacaactattgtcaatcttttgatgaagttctatgagattgataagggaagtatccgtatcgatggtgtggataccaaggatatgaagcgttcggaagtacacaatgccttttcaatggtcttgcaggatacttggctctttgaaaggca

SEQ ID NO: 58 - DNA, 314111 bp, Streptococcus mitis NCTC 12261 contig4
gcagccgaacgaccgagcgcagcgagtcagtgagcgaggaagcggaagagcgcccaatacgcaaaccgcctctccccgcgcgttggccgattcattaatgcagagcttgcatgcctgcaggtcgactctagaggatccccctgtgctaggatggtcacctagatcaggaaacagctatgaccccagtgtgctggaaagtcggcagtcagagcttctggacgttcagaaacataggcatcaatgacaccagcctcaagtgcttggcgcatttgagcgaagtctcccatggcagtttcttttttagcgcctgagatttgggaaatcaagtcataaaggtaaacaccttgttgagaagtgattttcgctccattaaagtcatccaaagatttggcatttgcataggcagaatcttttttgacaagtaggacaggctcgctagtgtagtagctgcttgaaaaggcgatttcttgtttgcgttcagcggttggactcatacctgcgataatcatgtcaatcttaccagaagtaagggcaggaactaaaccttcccacttggttttaacaaccaaaggttctttacctaagtccttagcgattttcttggcaatttggacatcgtatccattggcatactggttggttccatcgattttgacagctccgttgctatcatcatcctgggtccagttaaagggagcatatgctgcttccatcccgatgcgtaaatattcatcagcttgagcaacattgacaagtcccagcatcagcaagaaacttgtgaaaatagataagtatatttttctcatgatttctcctatttctaatctattaaaaaataactgtctcctattttatcgaaaaaaactctatttttcaatacaggtaagcccttacttgagaaaaaatgatataatgatagcaaagataaaaagggggtttagttgatgaaaaaaacttttttcttactagtgttaggcttgttttgccttctgccactttctgtttttgccattgatttcaagataaactcttatcaaggtgatttgtatattcatgcagacaatacggcagaatttagacagaagatagtttatcagtttgaggaggactttaaggggcaaatcgtgggactgggacgtgctggcaagatgcctagtggatttgacattgaccctcatccaaaggttcaggcatcgaaaaatggtgatgaactagcagacgttactagcgaagtgatagaaggcgcagatggttatactgttaaagtttataatccaggtcaggagggtgacacagttgaagttgaccttgtctggaatttaaagaacttgctttttctttatgaagatatcgctgaattaaattggcaacctttaacagacagttcaggggctattggaaagtttgaatttcatgtaaggggagaaaaggaggctgaaaaactctacttccatacagggaaactctttaaagaaggaacgattgaaaagagtaaccttgattatactattcgtttagataatcttccgtctaagcgtggagttgaattgcatgcctattggcctcgaactgattttgctagcgctacggatcagggcttgaaaggaaatcgtttagaagagtttaataagatagaagactcgattgttagagaaaaagatcagagtatgcagctcgtcacttgggtgtttcctttgatactttccatttccttgttattgagtgtctgcttctattttatttatagaagaaagaccactccttcagtcaaatatgccaaaaatcatcgtctctatgagccaccaatggaattagaaccaatggttttatcggaggctatttactcgacctccttggaggaagtgagtcccttagtcaagggggctggcaaatttacctttgaccaacttattcaagctaccttgctagatgtgatagaccgtgggaatgtttctattatttcagaaggagatgcagttggcttgagactggtgaaagaagatggcttgtcaagttttgagatagactgtctaaatctggccttttcaggcaaaaaagaagcaactctttccaatttgtttgcggattacaaggtatctgatagtctttatcgtagagcaaaagcctctgatgaaaaacggattcaagcaaaggggcttcaactcaaatcttcttttgaagaagtattgaaccagatgcaagaaggagtgagaaaacgagtttccttctgggggctcccagattattatcgtcctttaactggtggggaaaaggccttgcaagtgggtatgggactctctactatcttgcctttatttatcggatttggtttgttcttgtacagtttggatgtttatggctatctttacctccccttgccaatacttggttttctaggtttggttttggctgttttctattattggaagcttcgtctagataatcgtgatggtgtcctaaatgaagcaggggcagaagtctactatctctggaccagttttgaaaatatgttgcgtgagattgcacgattggatcaggctgaattggaaagtattgtggtctggaatcgcctcttggtctatgcgactttatttggctatgcggacaaggtcagccatttgatgaaggttcatcatatccaagtggaaaatccagatatcaacctctatgtagcttatggttggcatagtatgttttatcattcaagtgcgcaaatgagccattatgccagcgtcgcaaacacagcaagtacctattccgtatcttctggaagtggaagttctggcggtggcttctctggaggaggaggcggtggcagtatcggtgccttttaaagagaactgccatatactgaaaaagtatgctataatggaagatagaaaaaggagtaatctatgtatcttattgaaattttaaaatctatcttcttcgggattgttgaaggaattacggaatggttgccgatttcgagtacaggtcacttgattttagcagaggagtttatccaataccaaaatcaaaatgaagcctttatgtccatgtttaatgtcgtgattcagcttggtgctattttagcggttatggtcatttactttaacaagctcaatcctttcaaatcgactaaggataagcaggaagttcgtaagacttggagactgtggttgaaggtcttggttgccactttgcctttacttgccgtctttaaatttgatgattggtttgatacccacttccataacatggtttctgttgctctcatgttgattatctatgggattgcctttatctatttggaaaagcgcaatgaagcgcgtgctatagagccaagtgtaacagagttggacaaacttccttatacgacagcattctatatcggactcttccaagttcttgcccttttaccaggaactagccgttcaggagcgactattgtcggtggtttgttaaatggaaccagtcgttctgttgtgacggaatttaccttctatcttggaattcctgttatgtttggagctagtgccttaaagattttcaaatttataaaagcaggacaactcttgagctttgggcaattgttcttgctcttggttgcgatgggagtagcctttgcagtcagcatggtcgctattcgtttcttgacaagctatgtaaaaaaacacgactttaccctttttggtaaataccgtatcgtgcttggtagtgtcttactactttacagctttgtccgtttatttgtataagaaaaaccttgaaggggcaactcttcaaggttttatactcttcgaaaatctcttcaaactgcatcagctctatctgcaacctcaaaacagtgttttgagcagcctgcggctagctttctagtttgctctttgattttcattgagctttaaaatccagttacggtaatccccagcaggcggacgcctttttctttctcgtccaactcttcatagagttgcagggctatttggctgatctgactagcatcctgcgttttttgatccagactttttcgtttagtcagagttgaaaagtcttcgtagcggattttcagaatgacaatttttccagctttttcttgttgactgagattgagagcgactctttctgataggagagtcagctcttttttgatgtcttcctcggcacggagaatttttccataggttttctctttcccgattgatttacggatacgattggatttgaccggggaattgtgaataccacgagcctttcgataaaggtcatagcccagtctgccaaaacggtctatcagggtcacttcagggacttcaagcaaatcagcgccggtaaaaacacccatttgatgaagtctttccaccgtcttttttcctactccatgaaacttggaaatatccatttgtttgaggaaatcctcagcctggtcaggtaaaatcactgtcagaccatgtggcttttgataatcgctggccattttagctaagaatttgttgtaggagacgcctgcggaagcagtcaggtgtagttcctgccagatatcctcttgaatgagacgagcaattttgaccgctgacttgataccgagtttattttctgtcacatctaaataggcttcgtcaatgctcatgggttcaatcaaatctgtataacgcttaaagatagctcgaatctggaggcccacagtcttgtatttctcataattccctgagataaagacggcctggggacaacgctcataggcttctttggaactcatggctgaatggacaccaaaagctcgcgcctcatagctacaagtggaaacgacaccacgcccacctgtttgtcgagggtcgctaccgataatgacaggttttcctctgagtttaggattatctctgatttcgaccgcagcaaaaaaggcatccatgtcaatatggatgatttttcttgacaaatcatttaataaaggaaaaatcaacatgtctggtcccctttttactgcttattttcttttattatacccttttttctgaaaaaaagaaaaaaggctttaattttttcaaaaatataatacagtttgggataaaatatagactgttttagaaaagaaagtgtaaaaatagggatttatcacttgttgaaatcggttactgtatggtatacttgtctcatgaatgtaacagatggatgttactagaaagaaaaaagaggacattaacatggttgttaagacagttgttgaagcacaagatatttttgacaaagcttgggaaggcttcaaaggcgtagattggaaagaaaaagcaagtgtgtcacgctttgtacaagctaactacacaccttatgacggagacgaaagcttccttgcaggaccaacagaacgttcacttcacatcaaaaaaattgtagaagaaactaaggctcactacgaagaaactcgtttcccaatggacactcgtccaacttctatcgctgatatccctgcaggatttatcgataaagaaaacgaagttatctttggtatccaaaatgacgaactcttcaaattgaacttcatgccaaaaggtggtatccgtatggctgaaaccactttgaaagaaaatggatacgaaccagacccagctgttcacgaaatcttcactaaatacgtaacaacagttaacgacggtatcttccgcgcttacacttcaaacattcgtcgcgctcgtcacgctcacactgtaactggtcttccagatgcatactcacgcggacgtattatcggtgtttacgcacgtcttgctctttacggtgcagactacttgatgcaagaaaaagtaaacgactggaatgcaatcgaagaaatcgatgaagaaacaatccgtcttcgtgaagaaatcaaccttcaataccaagcattgcaacaagttgttcgcttgggtgacctttacggagttgacgttcgcaaaccagcgatgaacgttaaagaagcaatccaatgggttaacatcgccttcatgtctgtctgccgtgttatcaacggtgctgctacatctctaggacgtgtgccaatcgtattggacatctttgcagaacgtgaccttgctcgtggtacatttactgaatcagaaatccaagaattcgttgatgatttcgttatgaaacttcgtacagttaaatttgctcgtacaaaagcttatgaccaattgtactcaggtgacccaactttcatcacaacttctatggctggtatgggtaacgacggtcgtcaccgtgttactaagatggactaccgtttcttgaacactcttgacaatatcggtaactctccagaaccaaacttgacagttctttggactgacaaattgccatacaacttccgtcgctactgtatgcatatgagccacaaacactcttctatccaatacgaaggtgttacaacaatggccaaagacggatacggtgaaatgagctgtatctcatgctgtgtgtctccacttgacccagaaaatgaagaacaacgccacaacatccagtacttcggtgcacgtgtaaatgtattgaaagctcttcttactggtttgaacggtggttacgacgatgttcacaaagactacaaagtatttgacatcgaaccaatccgtgacgaagttcttgaattcgaatcagttaaagaaaactttgaaaaatctcttgactggttgactgatacttacgtagatgctttgaacatcatccactacatgactgataagtacaactacgaagctgttcaaatggccttcttgccaactaaacaacgtgcgaacatgggattcggtatctgtggatttgctaacactgttgatacattgtcagctatcaaatacgctacagttaaaccaatccgtgacgaaaatggctacatctacgattacgaaacaatcggtgaatacccacgttggggtgaagatgatcctcgttcaaacgaattggcagaatggttgattgaagcttacacaactcgtctacgtagccacaaactttacaaagatgcagaagctacagtatcacttttgacaatcacatctaacgttgcttactctaaacaaactggtaactcaccagtccacaaaggtgtatacctcaacgaagatggttctgtgaacttgtctaaacttgaattcttctcaccaggtgctaacccatctaacaaagctaaaggtggatggttgcaaaacttgaactcactttctagccttgactttagttacgcagctgatggtatctcattgactacacaagtttcacctcgcgcgcttggtaagactcgtgacgaacaagttgataacttggtaacaatccttgatggttacttcgaaaacggtggacaacacgttaacttgaacgttatggacttgaacgatgtttacgaaaagatcatgtcaggtgaagacgttatcgtacgtatctctggatactgtgtaaacactaaatacctcactccagaacaaaaaactgaattgacacaacgtgtcttccacgaagttctttcaatggatgatgcattgagctaatcaattaacttgaataaggaaaaggaaccctcggtcaaacgactgagggttattttttggactattaaattccttaagtcaggtattgaaatgtctgaccgggattcaaagatacttgttgagttgcgggaggtatttgatattcaatgaaaatcaaagagcaaactaggaagctagccgcaggttgctcaaagcaccgctttgaggttgtagataagactgacaaagtcagtcacacatatacggcaaggcgaagctgacgtggtatttttattttcgaagagtatgaaaataaaaataccacactttgtaggtttacaaggtgtggttgtattttatctcttagaccaagttctcttcataaagagaagtaggattggataaatctccaagcgccctgcaatcattgcaaaggagaggagaatttttgagataggactaaagattgagaaactagaagtggttcctagaataggtccgatattattgaaacagctaaagacagcactggtaacgactagaaaatcattgctatctaggctgacaataaagataagggatagcaaaatcatagaatagatgacaaagtacttgagaatcttatgctgggtatctttgtcaatcaccgttttattaacatggagggtcaaaacacggtggggcgatagaattgacaaaatttggtttttggcaatttttgaaaggatgaggcctcgaataaccttgagtccacctgcggttgaaccagcagaaccaccgattcccatgaggaagagaaggataaactgggagaagaggggccagttggtaatgtctccgtaaccaaaaccagtcgttgtaatgatattggaaacctggaagaaggccatttcaaaactctttgaaaatcctggatagagatagagggtattaaggctaatcaagcctgtagaaagcagaacaatgaccaagtaagcacgaagttcctcgtcaccaaagaaggctttgacgcgacggagcatgaggtagtagtagagattgaaatttaccccaaaaaccagaactccgatactaaccagataggtaatcagtgagctgccatagtgggcaatcccgtcgttatagacggtaaagcctcctgtacctgctgtccccatagcaatgacaaaactatcaaataggggcatgccagccagataatagatgatgacaaagagggagaagagagctagataaaggagatagagaatctgggcagtgttttttagtttggatactactttaccaaaaacagggccaggaacctcagccttcatcacttctaggtgactattcttggcattatccataatagcaagtgcaaaaacaagcactcccatccctccaatcaagtgggtaaaacttcgccagaagaggagggaacgactgaggaccgaaacgtcgttcagaatagttgctccagtagttgtaaagccagaactgatttcaaaaaaggcatcgataacgctgggaatttgcttagcaaaaacaaaggggagaccgccaaagaaggaccaaaggatccaacagagggcaacaatcaagactccctccttggcataaatccgttgatttttgggcttttgtaaaattcctgaaccgcctagtaatacgagaatccctattgttgaaaagagggccgtaaagacttggctcgattcacggtaatagacagcgacagacacaggaaccaaaagaagaacagcttcaatcaaaagtaattttgaaaggaggtaacgaatcatacttttattcatttcttacctcgtgatcaagtcataaatcttagtgatgtttggcaacaaagttgttactaggagcttgtctccaacttccaacatatcctccccagtagggaaaatagtcttgccctttcgaatgatggctgctataagaaccccttttttcagttttagttgagaaagaggtttggcagtcattttattagcttccttgatatgaaattgcagggtttcgatttggccattggctagatggtgcatggcctgaaggtctgaatactgggcattaacccgaccacgaataaagtgcataatcgtatctacagcgatgcttttaggtgtgatgatacttgaaaaatcaggcgcattgataatttcgaggagactggtacgattgaccttggtgatatttttttgtacacctaccctgtcaaggaacatagaggtaatcagattttcctcatcaacccctgttagagtcgcaacggcatcatagttttgagcactttcttccagcaggatatcttttgcggtaccatctccttgaacgatgtagaggtttgggaatttctcgctaaagaagctagcgatttcaggattgatttcaataaccttggtatcaatacgactgtcttttaggatacctagtagataataggcgattctaccagctccaacaataagaaggctcttcacggcacgagatttaaaataattatggaagagcatcatatcaacacggttaccagtgacaaagattctatctttatcctgtatggtcatgtcaccgcttggaatgataatttgatgatccctctctatagcgcagacaataacattgccaaattttttacgaaaatcagaaatgggcatttggcaaagaccgctggaagatttaacagtgaattccatgaggctaacgcgtccaccaaagaaacgttcgacagagagggcgttggggaagtcaatgatattcgcgatagcgcgggcagccaagagctcagggttaacgataagagaaaaaccgagaatattcttttccttgaaataagagttagaatattcagggttccgcacccgaacgatggtctctttagctcccatttttttggctagaacggctgcaatcatgttcacttcatcgtattcagtcagggcgataaagatatcacaatcctggacactggcttgctcaaggatggtaaaatcggccccgttaccaaggatacccatgatatcaaagcgattaacaatatgattgagaacagcttcgtcttgctcaatcagcaaaacatcatgcttttctgcaaccaaggagcgacagagggcagaaccaacttttccccctccgacaaggataattttcataataaaacctactttttcatgatgtaactatcataccttttttcaagaaaaaatgcacctactagctaataacaagagcttttagtaggaaatttgctataaggtaaaactataccctaatcaattgaaatagctattagcgactttctctgaaatatggtatgataaaggatatacaaggagataaaatgaataataatttactggtattacaatcagactttggtctggttgatggtgcggtatcggctatgattggagtggctttagaagaatctccaaccttaaaaattcatcatttgacgcacgatatcacgccttataatatttttgaggggagctatcgtctctttcagacggtagattactggcctgagggaacgacatttgtatcggtggtcgatccaggtgtcggctcgaaacgtaagagtgtagttgccaagactgtaaaaaatcaatacattgtcacgccagacaatggaacgctttcttttatcaagaaacacgttggtattgtagccattcgtgaaatttctgaagtggccaatagacgtcaaaacacagagcattcttatactttccacggtcgtgatgtttatgcttatactggtgctaaactggctagtggtcacattagttttgaggaagtggggccagagctcagtgtagatcagattgtggaacttccagtcgtagagacaatcattgaagatcatctggtaaagggagctattgatattctagatgtgcgttttggttcgctttggacctctgtcacacgagaagaattttacaaactggaaccagactttggtgaccgttttgaagtgactatctatcacgcagatatgctggtttatcaaaatcaggttgtttatggcaaatcatttgcagatgtgagaattgggcaacccatcctttacatcaactctctctatcgtttaggtttggctatcaaccaaggttcctttgccaaggcctataatgtaggtgtcggttcatcttggaccattgaaataaagaaaatagaatcataaaataggagaatatagatgaaaaatcaatcaattaaacaagttgttgctatcggtgttggagctgcgctcttcgttgtcatcgggatgatcagcattccgacacctgttccaaatacaagcatccagcttcagtatgcggtacagagcctcttgtctatcatttttggccctctagtgggattacttgttggtttaattggtcatgcagtgaaggactctcttgctggctacggtctttggtggacttggattattgctagtggtctatttggtctagtcgtcggactctttagaaaatacattcgagtaacacagggtgtttttgagttgaaggatattgtcttctttaacctcattcagattgttgcaaatgctcttgtttggggtgtcttggcaccacttggagatgttgtgatttatcaagaagctgcagaaaaagtatttgcccaagggattgttgcgggaattgctaatgctgtaactgtagctatcgcaggtactcttctcttgctagcttattcacgtacgcagactcgttcaggaagtttgaaaaaggattaacataaaggcaaaggctgggcaaccagtctttttcgatgtttatagactagtcaggcaagtaagctaggataggaatctttttggcgctaagattttaagagaagagactgcaagaaggggtagatttatgataaaatagaagtctaagaagcgaatgaagagagtaagatgaaagaagctataattgagtggaaggatttctctttccggtatgaaacacaacaagaaccgaccttgcaaggggtggacttgaccatttataagggagagaaagtcttaattgttgggccatctgggtcaggtaagtctaccttgggtcaatgtttgaatgggattattcccaatatttacaagggtcagacgtctggagaatttttgatcaaggggcaagcggcctttgatatgagtatctatgataagtctcatctggtcagtacagttttgcaggatactgatgggcagtttatcggtctgtctgtggcagaagatttggcttttgctctagaaaatgatgtaacaagtttagaagagatgaaaagccgtgttcataaatgggctgaaaagctggaccttctttctttactgtctcagcgtcctcaggatttgtcaggtggacaaaagcagcgggtcagtctggctggtgtcttgattgatgagagtccgattcttttgtttgatgagccacttgccaatctggatcccaagtcaggtcaggatattatcgaattgattgaccagattcataaggaagagggaacgacgacacttattattgagcatcgtttggaggatgttctgcatcgccctgtggatcggattgtcttgatcaatgatggtcgtattctctttaatgggagccctgaccagctactggcgactgatttattgacccaaaatggaattcgagaacccctttatctaaccactctccgtcaattgggtgtggatttagccaaggaagaacaattagcaaatctggataacttgtctatctcaaaaggccagattcagttgcggacggaactggtaaaagaaaccccagaattgcagtcactctttaaattagaggatgtgtctttttcttatgatgatagaccgattttaaaatccatttatttagatattaaaaagggtgaaaagattgccattgtcggaaaaaatggagcagggaaatcaactctagccaaggccataagtagctttatccagacggaaggccgctatctttgggaagagcaggatataaaaggagattcggtagcagaacgggcggaacgagtaggctatgtgctgcaaaatcctaatcaaatgatttcaaccaatatgatttttgatgaggtggctctagggctccgtttgcgaggtgtgaatgagaaggaaattgaaacgagagtctatgaaaccttgaaaatctgcggtctctatgaattccgtaattggcccatttctgccctgtcatttggtcagaaaaaacgtgtcactattgcatcgattttggttttaggagctgaaattatcctcctagatgaaccgactgcaggtcaggaccagaagaactatactgagattatggaatttctcgaagagttgcatcaaaaagggcataccattgtcatgattactcatgatatgcaattgatgctggattattcagaccgagctcttgtcatggtggatggggaactgattgccgataccgatccagctagtctgttgagcaatcctgagctgttagtaaaagccaatctaaaagaaacttcaatcttcaacttggccaagaaactagacgtggatccacttgctttaacggcattttataaagaaaggagagaaggatgcaagctaaattaatcggttaccagcatagagatactgtgattcatcgcttgtcaggagctggtaaactcctctttttcatccttgtatcattggcggccatgattagctatgataccagactgcttgttctgattgctattttttcggtctttctcctctatttgtcagaaatccgctttaaagatgtttcctttgtagccgtttttgcgacggtatttgccgttttaaacgtcttgatggtctatctcttttctcccgagtatggggttggactttacggagagaggagtgtgatttggcagggaatcggtgcctacactctgaccagccaagagctcttttatctgctaaatctggccattaagtacctttgcactattcctctggctattatctttttgatgacaacccatcctagtcagtttgcttccagtttaaatcaaattggtgtgccttacaagattgcctattcagtcagcctgactttgcgctatattccagatttgcaggaagaattctttactatcaagatgtctcaggaggcgcgtgggatggaattatccaagaaagcttctcttatgcaacgaatcaaaggcaatctgcgcattattacgcccttgatttttagctcgttagaacgcattgataccatcgcgaccgccatggagcttcggcgctttgggaaagagaaaaaacgcacttggtatagttatcaggccttgaaaaaaggagattatcttaccttgctcttggcagccttgtttttagtagctagtttactacttatcttgcagaatcagggacgattttacaacccttggaaatagcttgaaaaaattgaaaaaatcaagtcgtttctattgacaatgattctgaaagtgttatactaagaaagtagtttcgctgatttacttcaaacctgttgtgaggtaagttaacgatgccttaaccacgctgtttgctgagcttgactccgggcagtgtggctatttttttgcaatggtgaaaggaagcaagtcatgacaaatcacattgtattatttgaacctcaaattccacaaaatacaggcaatatcgcgcgtacttgcgctgcgaccaattctcccctccacatcatcaagccaatgggctttcctatcgatgatcgcaagatgaagcgggcggggttggattattgggataagctagagatttatttttacgagagtttggaggatttcatgtctcagatgaagggcaaactctacctgatttctaaattcgctgagaaagtgtattctgatgtggatttatcgactgacgaggaccattattttctttttggacgtgaagacaagggtttacctgaagactttatgcgcgaacatcctgagaaggctcttcgtattcctatgaatgatgaacatgtccgcagtcttaatgtgtctaataccgtctgcatgattgtctatgaggctcttcgccagcagaactttgcaggtcttgagcttgttcatacctatgaagtggataaattgaaataaaaaatgaaaatgaaaatgaacaaaatgcttgcgcttgcaagcgttttttgttatgataaaagagtcttcagggcagggtgtgattcccgaccggcggtgactttaactaggaaatgatcttttccttttatactttgttgacaagctttgcctaaccagaagttatgcctacagcttgtcgcctagtctaaaagaaaaatctctatttccttctctttaaagaagtccgcgagcgcaagctgatgtggtgagattccacaaccgacagtatagtctggatgggagaagacgaaagaatagctttgtctgttctgatagatttatagctaaactgtaaccgcttgcttgaatttccttaatagagtgagagggaacttttgggatataaaaagtgagaatagatagaaaatcctttctaacttcttctgattttatagaaaattggaggaacctgttatgacaaacacacgtcgactttcgaccattgcaattctatcagctatctcatttgtgctgatgtactttgactttccgcttttaccagcggcatccttccttaagatcgaatttagtatcttgccagtccttgtgggcttggtggtcatggatttgcctgctgctctaggaattctcttgcttcgctcactcttgaagctgcttcttaacagccagggagtgaatacttacattggtttgccaatgaatatcgtagctttgggagtttttgtcatcgtatttgctttgatttggaaaaaggaacggacaacccttcgtttcctactaggctctctagctggaactattggcttgaccgtggctatgttggttctcaactatgtttacgctgttcctttgtacgctaagtttgctaactttgatattggaaaaattttgggactttccaactacctaatgaccatggtattaccttttaacttgattgagggagtaatcttttccgtttcattctggttgttgtatattctcttgaaaccaaccttaaaacattatgaaagataaacaaacatttttaatgaagggcagttttgcccttttacttttcgttattcttggctacatggtcaaattttaccctgaaacgctggtcggttttgaccaaccgatacagactgccgttcgaggagacttgccagattacttgactattcttttccgagccatcacacgcctgattgatatcccagtgattatcacttgggttgtcatcgtagcctttatcttttatcgtaagcggtggaagatagaaagtttcttcatgctagggaatttggctttggctggtcttttaatcgtgacctttaaaaatatctaccagcgcccacgaccagctattttacacttggttgaggagaagggattttccttcccaagcggccattctctggctgtaaccttgctggtcggttctctgattgtcattctcagtcaacggattaaaaatccagtctggagaaaaatcgtgcaaatcgtccttggtctctacctagtcagtgtgctggtatcaagggtctatctgggagttcactatccatcagatgtccttgccagtctctgtgtgggcttgggagtcctgtttatcgagtttcccttctatgacaagctccgattccaatggcgatttaaaggcaagcagaagtgagtatcaaattcctttgaggagaaagaaatgaaagtcaatatagcagatcttcatccgactcaactatacttatcagaaaagaagttgcaagatattcagatgctttaccagtcggcagaaacaatccaagtcgatccaatcagtattcttgcctttggaaattgcttgttgattacagatggacatcacagggcttatcaggctttattggcaggtcgggatacgatttctgctgagtgggatagagatggtggtgatgaactatatcatctctatgcgcaagcttgtgaggaaagaatgatttactctgttctggatttaaaaaatcatatcttagctcaagatgagtatgaagcaaaatggtataactggtgtgatggttttaatcaagcagcaactctcttattgaaaaggaaagcagatgaaacaggccttataaataggtagtgcattgtgtcttgttcctttttatactgaaattagtctaatctaacttgttttttaactaaaaatctgataaactatgtagtaattgaatagaaatccgcaagactagtagcctaagggaagtatatcagggaggagagccgtgactgcaagctctctatatgaaagctgggtgaattcacttgcgcatggatttagaaatgaaggtctgacttgtcagatgaaaacggatggtaccgcgtgtcaacgctccgagtggagtttttggcatgtggttttctttttatctacgagcgactgatggaggaaatatgtcaactattgaagaacaattaaaagcgcttcgcgaagaaacgctggctagcttgaagcagattactgctgaaaatgaaaaagagatgcaagatttgcgtgtctctgtccttggtaaaaagggttcgctcactgaaatcctcaaagggatgaaagatgtttctgctgagatgcgtccaatcattgggaaacacgtcaatgaagctcgtgatgtcttgacagctacctttgaagaaacagctaagctcttggaagaaaagaaagtcgcggctcaactggctagcgagagtatcgatgtgacgcttccaggtcgtccagttgcgactggtcaccgtcatgtcctcacacaaaccagtgaggaaatcgaagatattttcattgggatgggttaccaagtcgtggatggttttgaagtggagcaagactactataactttgagcgtatgaaccttccaaaagaccacccagctcgtgatatgcaggacactttctatatcacagaagagatcttactccgtactcacacgtctccagttcaagcgcgtgcaatggatgctcatgatttctctaaaggccctttgaaaatgatctcaccagggcgtgtgttccgtcgtgacacagacgatgcgacccacagtcaccagttccaccaaattgaaggcttggttgttgggaaaaatatctctatggctgatcttcaaggaacccttcagttgattgtgcaaaaaatgttcggtgaagagcgtcagatccgtctgcgcccatcttacttcccattcacagagccatctgttgaggtggatgtttcttgcttcaagtgtggtggagaaggctgtaacgtatgtaagaaaacaggttggatcgaaattatgggggccggtatggttcacccacgtgtccttgaaatgagtggtatcgatgcgactgtttactctggatttgcctttggtcttggacaagagcgtgtagctatgctccgttatggaatcaacgatatccgtggattctaccaaggcgatgtccgcttctcagaacagtttaaataatgattagaaaagtagaaaaggcagatgttggggtgttgtccaaaattgccaaacaaacctttcgtgaaacatttgctcatgataatacagaagagcagttacaggaatactttgaagaggcttatagtttgagagttttgtcaactgagttggaaaatccagaatccgaaacctatttcattatgcatgaagaggagatagctggttttctcaaagtcaactggggaagtgctcagactgagagagaattagaggatgcttttgaaattcaacgtctctatgtgctacaaaaattccaaggatttggactaggtaagcaactgtttgaatttgctctggaacttgctacaaaaaatagtttttcctgggcttggttaggtgtttgggagcataatacaaaagctcaagcgttttataatcgatatggttttgaaaaatttagccaacatcattttatggttggtcaaaaagtagatacggattggttactgagaaagaaattaaggtaagaagatgattcttctattgaaatgataggaaaggaaaagaactagagtgacaactgtcattctggaaaactaaattatgcttgtatcttataaatggttaaaagaattggtggacattgatgtgccatcacaggagttggctgaaaaaatgtcaactacagggatcgaggtagagggtgtcgaatcaccagctgctggtctctcaaaaattgtcgtcggtgaggtcttgtcttgcgaagatgtgccagaaactcacctccatgtttgtcaggttaacgttggcgaagaagaagctcgtcaaatcgtttgtggtgccccaaatgtgcgtgctggtatcaaggttatggtggctcttccaggagctcgcatcgctgacaactacaaaatcaaaaaagggaaaatccgtggcttagagtcacttgggatgatttgttcacttggcgaattgggaatttctgactcggttgtgcctaaggaattcgcagatggtatccaaatcttgccagaaaatgccgttcctggggatgaagtcttctcttacctagacttggatgatgaaatcatcgaactttctatcacaccaaaccgtgcggacgctctttctatgcgtggagtagctcacgaagttgcatccatctatgacaaggcggtcaactttaaagaatttactctaacagaaacaaacgaagccgctacagatgcactttctgtaggcattgaaacagacaaggctccttactatgcggctcgtatcttggacaatgtgaccatcgcaccaagtccacaatggttgcaaaatctcctcatgaacgaaggtattcgtcccatcaataacgtagtggacgtgaccaactacatcctgctctactttggtcaaccaatgcatgcctttgacttggatacctttgaaggaactgacatccgtgtgcgtgaagcgcgtgctggtgaaaaattggtgaccttggacggtgaagaacgtgacttggacgtgaatgacctagtcatcactgtcgcagacaagccagtagctcttgcaggtgttatgggtggtcaagcaacagaaatctctgagaaatctagtcgtgtcgtccttgaagctgcagtcttcaacggaaaatcaatacgtaagaccagcggtcgtctcaaccttcgttctgagtcatcttctcgctttgaaaaagggattaatgtggcaactgttaacgaagctcttgatgcggcagctagcatgattgcagagcttgcaggtgcgactgtgcgtaagggtatcgtttcagcgggtgaacttgatacctctgatgtggaagtttcttcaactcttgctgatgttaaccgtgtccttggtacagaactttcttacgcggatgtagaagacgtcttccgtcgtcttggctttggcctttctggaagtgcagatagctttacagtcagcgtcccacgtcgtcgctgggatatcactatcgaggcagacctctttgaagaaatcgctcgtatctatggttatgaccgcttgccaaccagccttccaaaagatgatggtacagctggtgaattgacagccacacaaaaactccgccgtcaagttcgtaccattgctgaaggggcaggtttgacagaaatcatcacctatgctctaacaactcctgaaaaagcagttgagtttacggctcaaccaagtaaccttactgaactcatgtggccaatgacagtggaccgttctgtcctccgtcaaaatatgatttctggtatccttgatacggtggcttacaacgtggctcgtaagaataaaaacttggccctttacgagattggaaaagtctttgaacaaacaggcaatccaaaagaagaacttccaaatgagatcaacagctttgcctttgccttgacaggcttggttgctgaaaaagatttccaaacagtagcagttccagttgatttcttctatgctaagggaatccttgaggccctctttgctcgtttgggactccaagtaacctatacggcaacatctgaaatcgctagcctccacccaggacgtacagctatgatttcactcggtgaccaagttcttggtttccttgggcaagtgcatccagtcactgctaaggcttacgatattccagaaacgtatgtagctgagctcaacctttcagccatcgaagctgcccttcaaccagctgctccatttgtggaaatcacgaaattcccagcagttagccgtgacgttgccctccttctcaaggcagaagtgactcaccaagaggttgtggacgctatccaagctgcaggcgtaaaacgtttgacagatatcaaactctttgacgtcttctcaggcgaaaaattgggacttggtatgaagtcaatggcttatagcttgactttccaaaatccagaagatagcttaacggacgaagaagtcgcacgctatatggaaaaaatccaagcatcgctcgaagaaaaagtcaatgcagaagtgcgttaaagtatcaatccatcctttggggtggatttttgcttttcaaataacaattcaggatcaaaaatagacagttgaggaacagagaagataaattggagtttaccagtgtataatgtactcatagctcaaagtaccctaagattttttactaaaatgaggatgataaaaatggacagaaatcattgtaaaggctatcaaaaaggagtataatgagtgcaagacatttcggaggtgaaagatgctagaagtaagaagtctagagaaaagttttggacccaagcaagttttgtttggtattgactttcaagcgcgaccaggtcgtattttgggattagtcgggaaaaacggtgctgggaagacaacgattttccacagtattttgaagtttttagaataccaaggagaaattagtctggataatcaggatattcgacaagagacctacgctcggattggctatctgcctgaagaacgcagcctcatgcctaaattgacagtccttgaacaagttcgttacttggcgactctaaaaggtatggatgccaaggagatcaaggaaaaactccctcaatggatgaagaggttggaagtgaaagggaagctgactgataaaatcaagagtctgtcaaaaggaaatcagcagaagattcagctcattattactctgattcatgagccagacttgattatcttggatgagcctttcagtggattggacccggtcaatacagaattgctcaagcaagtcatttttcaggaaaaagaacgtggggcaaccattatcttttctgaccatgtcatgaccaacgtcgaggagctttgtgacgatattctcatgattcgagatggccgtgtggtcttgcatggaccagttcaggatgtccgcaatcaatacgggaaaacgcgtctctttgtttcaagtgaacgaagcaaggaagaattggaaaatcttcctcatgtcaagcaggtaagtttgaccaaacaaggcagttggaaattgatcttagaggatgagagcgctggaagggaactcttcccaatcttgactcaggggcaatacatcgcaacctttgaccagcaagcgccaacaattgatgaaatctttaaactagaatcaggggtggaagtatgagaaatatgtgggttgtaatgaaggaaacctatcttcgacatgtcaaatcgtggagtttcttctttatggtgatttcgccgttcctctttttagccttatctgtaggaattggctatctccaaggatcttctatggctcagagtggcaagatagcagtagtcagcactgttccagctgtgacagacagtcttaaatctaccaatggtctcaattttgattatcaggatgaagccagtgcccaagctgctatcaaggatgaaaaattaaaaggctatctgaccattgaccaagaggatagtgtcttgaaggcagtttatcacggtgaaacttcccttgagattgctattaagctaggagtaacgagcaagttaaatgagcttcaagatcaactcaatcgttcggcagccaatttgtcacaagaacaggaaaaacgcttgggacaaacagttaactttacggagaaaattgatgaatccaaggaaaataaaaaaatgattcaaacctttgcggccgcagggcttggtttcttcctttatatgattttgattacctatgctagtgtcactgctcaggaagtggctagcgagaaaggaaccaaaattatggaggtggtcttctctagtatccgtgctagtcattatttctacgctcgcatgctggctctgcttcttgtgattttgacccatattggcatttacgtcgtgggtggaattgctgccattcttctctttaaagacctaccaatcttggcacaatctggtattttaaaccatataggagaggctttctcgctcaacaccttattgtttgtcttggttagcctctttatgtacgttgttttagcagccttcctaggctctatggtttctcgccctgaggatgcaggaaaagccttgtcgcctttgatgattttgattataggtggtttttttggagtgacagctctaggtacagctggtgacaatctcatcttgaagattggttcatatattccctttatttcgactttcttcatgccgtttagagctattaatggttatgcaaatgggttagaaacttggatttcgcttgctattacgcttgcttttgcagtaacggcaacagtctttatcggacgtatgtatgctagcctcgttctgcaaacagatgatttaggtccttggaaaacctttaaacgtgccttatcttataaatagaagagcctcgcgaaagcgaggttttttagagataaaaagagtggaattcagaaaaatatttttcatatctattgacttttaggggtgaaatttggtattatagtaggcggtattgtttaccccatttgaaaggccccggaaccttccaaatacttttcgatgggaaggaacacccatcaccgtaaacaaaaatcgaactatatataggagaaatcatgaacaaaacaacatttatggctaaaccaggccaagttgaacgtaaatggtacgtagttgacgcaactgatgtaccacttggacgtctttctgcagtagttgctagcgtacttcgcggaaaaaacaaaccaacatttacaccacacactgatacaggtgactttgtgattgttatcaatgctgaaaaagttaaattgactggtaaaaaagcaactgataaaatctactacactcactcaaaccacccaggtggattgaaacaaatctctgcaggtgaacttcgttctaaaaatgcagtacgtttgatcgagaaatcagttaaaggtatgcttccacacaatactcttggacgcgctcaaggtatgaagttgaaagtatttgttggagctgagcacactcacgctgcacaacaaccagaagttcttgatatttcaggacttatctaaggaaaggaacaataaagtatgtcacaagcacaatatgcaggtactggacgtcgtaaaaacgctgttgcacgcgttcgccttgttccaggaactggtaaaatcactgttaacaaaaaagatgttgaagagtacatcccacacgctgaccttcgtcttgtcatcaaccaaccattcgcagttacttcaactgcaggttcatacgacgttttcgttaacgttgtaggtggtggatacgcaggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaattctcaaaacgttaatcaatacgattatatcaacgtttcaaagcactttgcaaaaattttgcaaagtgcttttttgtcgatttttgagctcaaatagctttgtgataaccttctgataacctcttctaaatttttaaaatcatgatttattttgctttattgagatagtctgcaaatttgtcaatagagtttttctcaccagtttttgtggtgtgagtatagacatctaatgtcacctgactgcttgcatgaccgagacgttttgatgtattagaaggatcgattccaatttcagacataagtgttgcatgtgtatgtctaaacccatgtgggctaattggttttaatttatgctttttaataattcgattcagtacgttattaatgtaatcagcatgcaaaggttcaattttgtcattacttgatatgtaagagaacatatattcatcactaatattcagctttgtaagaggaagctgagattgttctttcagatagaaatttctccattgcttaataatatcgattgtctcatcatcaagatagattgtacgaactgaagattcattctttgtgctcttttcaatcgctttaccgtcaattcttcctagacttttatctatgttcaatagattgctgtcaaagttaatatcagcccattttaaagcgtataactccccttttcgtagtccactaaatgcaagcagtctaaataaagcaaaatgtttaaatggctcagtttctttcactatatcaaggaaatgatgtaattcctccagagaccaaaaattatctgatctagtttttttgattttaggcatgataacattcttcattggatttcgatcaatgtagttcatgttgattgcaaaatcaaaaatttttgaggtataggattttatctgtttgatatttttgaaagtctgagatttttgtgtaataaagttttgacagtctaaaggactgatttggtcaataaatttatcgccaaatattggtagaatatgtattcgatagatattcttagtttgggaagaagttgtttcttcaacggtaccaacataggcattaaaccattcttgataaagttctttataagtgactttggggttagttttgtcggtacttactgtgggggcaacgacaccagcttctaaacgagcttcgtacaattttgcctcttttttggttttgaaccctctctttaagtgcctttttttctttccataagcatctaagccaatgtaaaagctgacatagtataggattcctttttttgttttgtatttgtgtatagacattttttctccgtatctaagttttcggagcttatgtaattgagaaatgagtgtctatctattttttctatcttcttggcggatagcgtattcgtctgttttaatccagctctgccaaactttagaatctttattttggtgattcatataatctataaactcagacataaaacgtttgtttttctcagctaggtattctgagaatatatgacgaaattcatctgaaaaactatcatcaagtggtagtgttaatgccctttcgccaaattcgatactcttctttaacttctccatatcgcttttaaaaggtgtcacagaaccaattttagatgttttgaaactatctgtaacaattttaagatttgatggagcgtgtgggttgctatcaagtcccataatgtaagcgacggaaacattaaagtattttgccaatttttcagcattatcttttttaggtttgcggattccttgattgtatccagaaagtgtaggataggctatatttgtagcttcgctaatttctgtcaatttttttccgctattttctatcagtttagtaatatgattcgtcataagaacctcctttttatcattataacacattttattctttttgaataaaaaagcttgacaaaaattcaaaaaggatatataattcaaaatgaataacaaattaaatggtttcggagcttatttaatttagaaatgaggtgtgaatttatgtcggaaactactttagttgtccagcttcctaaagaattagagaagcaattacgtgctcactatgatgagatgatttcaaatgctgtagcaagagtatttgaagataaagaactttataaacccatggttcgtatgtcaggtttgtctaggtggttagatgtatctacgacaacaatccaaaaatggacgaaagaaggaatgccaaccatggtgattgatggagtgactttatacgataaaagagcagtaacaagatggttgaagcaatatgaaagataggtacttgtatgaatggtgttcagtggatcaagataacaacagatatatttgatgatgaaaaaattcagctaatagaatcaatgccagaaggagatactcttattgtaatatggtttaaaattctggtgcttgcaggaaagcaaaataatagtggcatattaagtctagggaacaaggtttattacacagaagagatgctttcaacagtgtttagacgaaaggctacatctgtaaaattagctctcagtatgtttgaagaatttggcatgatagaaatcatagatggcgctattaccattccaaaatgggagaaacatcagaatatagatggcctagaaaagattagaaaacaaacaagggaacgtgttgctcgccatagacaaaaacaaaaagcactaattaaaggcgagccacaactcattttagactgtaacgttacagtaacggatgaaaatgagaatgtaacgcaagagattaagaacaagagtaagaataagaaagagattgagaatatactggataatagttctagaaagactgaaacttatattccacccaaatattattctttgttagaatccatttcttataagtacaatgatagatttttgtatcctaacaattacactttaacacatgctcagaagatgaagataggcgagtatttggctagtgggtatataactagtgatgaagttattagcatgattgaacggattcctgaggatgcgacttctcctttagcgtatttatttaagtctatggagaatttaaagcaggaacgtatgctggagtgcaaagctattgcccatgaaaatgcccgaaagaagtatatgataaatgagtagatataggactgttctaaagaaatgttatatcactgaggagcaaaatgaaatagtgaataacttgattgaaatgacaaatcatctaagtttttcctcttatgccagaaaaatgttatttaagagctcgcctatttatcttcaatttgattttgaatcttatcatgactttatatttcaagttagaagaattatcaataacttacgtcagttagaaagaatagcagaacaaagtgaagatttggataatgtaaggatatttcactactgcgttgagctgatgatagaatatgaaaagaagacaagtaaacaagtgaaagaacttgtaaaacgactaaataagaaaacgaggtgataggaccatgagaataaaatctgtgttgaaacaggtgtttttgacggaagaagaaaataaaaaactaaatgattgtatgaggaaggaaaatattcgtaatttttctgagtttgctagacaaaaattaatacgaacagatttgaacatccaaaaagtctcttttgaaggtttagttcctttaacagaagagttggaacaagtcggaaagaatatcaattctatagcctgtcttgcaactgtagttgggagaataagctatgaaaacaaaatggatatgtctattttgatgcaaaaaatagttgatgtgatggaggaaaaagatgtttattttcaaaagtaatatggataaggattttgatcagatatgcgaatacatattgaaattaaagcgagcagaattatttcttcatggaattaaacaacaagataaaacgaaggctcgtttgtatcatgcgatgctggaatactatgatgctaaccataaaaaagaaagacatatgagaattttaaaataaggaaacgctgttaaaaattttgcagcgttttttatatatcttcttaaaatatttgtacacacaaatgacagtcaaattgatttttgggattattttatcgagaaggaaagatttctcataatatgactttgcgagctcagagtctgtatacacacactcccaaaatcatcccaaaatttgtatacacaaagtgtatgtactttttgggatgatttgaattttggggaatccccaaacccctgatgaattatacgagcaaaaaaatacccgctatgcgggtgtgtactgacccccaaaagttagacagaaaaaatctaacttttggggtcagtacaaaagcgtttttattgtataaagaatatcaaatagtttgagggttttacttgtcgctgtatttcttcactatcctttttgtaatactcctgctttgttcctgaaatatctacagtgaatacgtcatccttgaaggtataattctcttttcggtttatgatattagagccagtcggttcgattgttgcactgtctttatcaattgtaaaggtgtcggcctctcctttgttgctatttcctttgttacctgaaatggtaaaggcaacttcatttctactctcgtttattcaacggtattcgccatctaaagaattgcttgattggttagaacatgcaattaataaaattgtagatagagacactaaaagtaatgtgataaatcttttcatttacatactttttatttctatattatattaaagaaacattacataagtaagaaagtaattttttaggttgatctctttctttcgggaaaatcattatgtttcggaaagtcaagattttgttattatttatgatatactggtaccgtaattatatccttacagaggttaagtaagggtttcagtacacgtcaatagatgtcaaaatattgattttaagcgatttttgatttttggaaactcattatatcacactacaaatcaataaaaactctaccttttttagataaatatatcatctggatattgaagtttaagccctgctgtcatttcgatggcagggctttttaatatttggtacactaacttcttatctatattttggtagattttaagttgacatctacaaagtttaatgttagaatacattcaaaaatatatttgaatgaggtattttatgattcaaaatgttgttacttcaataatcctgtattctgggacagccgtagacttacttattatcctaatgttattttttgccaaaagaaaaagcagaaaagacatcattaacatctatttaggacaatttctaggctctgttagtctaatattactaagtttgctttttgcatttgtcttaaattatattcctagtaaagagattttaggtttactcggtttgattccaattttcctaggcctcaaagttttgcttttaggagattctgatggagaagctattgccaaagaaggtttgcgcaaagataataaaaacctgatatttctagtcgctatgattacttttgcaagttgtggtgctgacaatattggtgtctttgtcccatattttactaccttaaatttagcaaatttgatagtagctttacttacctttctagtcatgatttatctcttggttttttctgcccaaaaattggcacaagtctcttctgttggagaaattttggagaaatatagcagatggtttattgccgttgtttatttaggattggggatatatatcctggttgaaaataacagttttgacatactatggactatattaggctaggagaaaatattatgaaaaaagatagtatctgccaagtgaatgttataaatcagcaaaatattacaaccgcaacgaactaccttgaaaaggaaaaagtccaaaaatcacttcgcattttaacaaaatttaccgataataaacagataaatatcatcttctatcttcttgctgttgaagaactctgtgtctgtgatatagcctgtttactaaatctcagtatggcatctacttcccaccatcttcgtaaactagccaatcaaaacatcttgggcactagaagagaggggaaaattatatattattttataaaagatgaggaaatcagggatttttttaatcaactaggataacagctatttttactacttttccatgattctagggagctactctatgaaatttcgggtcttcggaatatatagtggaattactttcttaatagtttaaaaacaactggtgtttaaatcggattttctggtgggatgttaggataatcaatagtattatataaaagtatcaatcacatacgagtgatactttgggaaaaaataaaatagtccaatttacttgaccgtgtactatggtacatggtttataatattcagggggtgaaataagatgatttatcgcattagtgagtttgcagataaatgtggagttaataaagaaacgatcagatattacgagcgaaaaaatttattacaagaacctcaccgaacggaagctggttatcggatatattcatatgatgacgttaagcgtgttgggcttattaaacgaatacaggaacttggtttctctttaagcgagatttataaattacttggtgttgtagataaagatgaagttcgttgtcaagatatgttcgaatttgtttctaaaaaacaaaaggaagtgcaaaaacaaatagaggatttaaaacgaattgaaactatgttagacgacttaaaacaacgatgtccagatgaaaagcaattacattcgtgtccaataatagaaacattaacatgagagattaattaacgaaaggagcttttttatgaataaatttaaggtaaacatttcaggaatgacttgtacgggttgtgaaaaacacgtagaatcagcacttgaaaagataggtgctaaaaatattgagtctagttatcgtcgtggtgaagcagtatttgaactgtccgatgatattgaggttgaaagtgcaataaaggcgattgctgacgcaaattatcacccgggcgaagcagaagaaatacaagtgcaatcggaaaaaaggacagatgtaagtttaaatgatgaaggtaactatgattatgattacatcatcatcggttctggtggagctgccttttcatctgccattgaagccgttactttgaacgcaaaagtggctatgattgagcgtggaacggtgggtggaacttgcgttaatgtcggatgcgttccttctaagaccttattaagagcaggggaaatcaatcatctagcaaaaaataatccatttgtgggattacacacttcggcttcaaatgttgatttagcgccattagtaaaacaaaagaatgatttagtaaccgagatgcgaaatgaaaaatatgtgaatttaattgatgattatggttttgaattaataaaaggtgaagcaaaattcgtaaatgaaaatacagttgaagtaaatggcaatcaaatcacagccaaaagatttttaatagctacaggtgcttcttcaactgcacctaatattcccggattagatgaagtagattatttaacaagcactagcttattggaattaaagaaggttccaaatcgtcttaccgtaattggttcaggatatatcggcatggaattaggacaactatttcataacctcgggtcagaagtcactttgattcaaagaagcgagcgtctattaaaagaatacgatcctgaaatttcagaagccattactaaggccttaacagaacagggaattaatttagtaacaggtgcaacctatgaacgagttgagcaagatggagacattaaaaaagttcatgttgagataaatggtaaaaagcgaattattgaagcagaacaattgctaattgccactggaagaaaaccaaatacagaatcattaaacttacatgcagcaggcgttgaagttggttcccgtggtgaaattgtcattgatgattatcttaaaacgaccaattcccgaatttattcagctggagatgtcactctcggtccccaatttgtttatgtagctgcttatgaaggtggacttgctgctcgtaatgcaatcggaggactaaatcaaaaggtcaatttagaagtggttccaggcgttacgtttacttctccatcgattgcaacggttggtttaacggagcaacaggcaaaagaaaaaggatatgaagtgaaaacatcggtattgccgttggatgctgttccaagagcgctcgttaatcgggaaacaacaggtgttttcaaattagtggcagacgcgaaaacattgaaagtgttaggggcgcatgtagtggcagaaaacgcaggagacgtaatttatgcagcaacattagctgtgaaattcggtttaactgttggagatctgagagaaacgatggctccatatctaacaatggcagaaggattgaagctggctgtcctaacttttgataaagatgtttcgaaattatcttgctgtgcaggctaagggaacttttttacaactccctattcaagtgaaccagctaatgctttaagggattttctaagtgcatttgtggtcacaaaaataatttaacactgatgatttcgacatcaaatctataattgataccttaacactgcagagtaataaaggatgaataatatgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacaattgaaccgtagacgatacaagtgtcgtgaatgcggatctaccttctgggaacgcctaatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgttaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagacaacttaggtgtcgatttttccacacttattaagaatttggagaagggtgatttataagcccttttccaccataaaatccgaatacccgaaattttttgatgaaaattactcacaagaaataatatatagaactgtttaaatatcttcaggatagaaaaagaaattgtccaggcacgaagaaactgtatatttgttgctaaactgtacatcatctttatgatacggtatttcgtatttctcaactacataagctccgaaaactaaaatgtgataaccctttgataacctctcgattttcaaaaggattatatatgtaaatattgaggatttatctcttaaaattacttgattttagtgataatttaccataaatatcataatgtagaaaaaaccaggtcttaagaaagctcgtaaagcttcacaattctcaaaacgttaatcaatacgattatatcaacgtttcaaagcactcaaaagtttaccttatgggtgcttttttcgtgtttttttgaaaagttcacctcaaagtttaccttattttcaccttattgttttagagactttaaagcaaattcacctactgtcataggaactacattagaagtatttacataaatctgtgttgttcctgtgtcactgtgtgttagagcctcagaaatagcttctaagctcattcctgcttgtttagcaagcgttgctcctgtatgtcgcagtttatgaggtgtagcatgtgccagctctttatgtcgctttctaatgcttttcattttattgtttagatagtcagcatgtaaaggcttgttgatgtttcctcttgtgtcgatatatgtaaaaacaaattgttctggattactgatgatgccaaactttgctagttcatatttttgttgctctttccaagaggtaagaagttgaagtaaatcattagaaatagagaaaatagttttcttatttccctttgttgattttacttctccatatctatctaaagcttgaattagctgaatctgtgattttgaaaaatcgatatgtttccattgaagagcataggtttcagattttctatcgcctaagaaaaaagtaagataaaataggacataatctttaagggttattttatcattctctaaatcttcttgaaatgctgagaaccattcttggagttgttcatgagttagatataaatcttcctctctctttgactctgcaagttgaatctttttagtagcttttattcgtcttaatatttttgcgattttattcgcttcaatatattccagttcttctgcccagtcaaaaatagaaatcacatagctacgtaaagatttaaagttcgcatattcgttagcttttgatgtcataaggtttaaaataacctgcttgttttgatttagaaactgtattgtataatttccaagaagtggtagtatatgtttttcaaaactacggactatctattagatggaaaaaatgacgacattgatttatcaaatatcgaagtattgttccgtatgacttctgatggattgacagaggaagaaaaggtaatctttcgcgatgagttgattgaattcatgaaagagcataaaaaactttttgatgaggacaaaaaatgagacttaaagaacatagacaacagcgtagaatggttcgtgcggaactggcaaaagaaatctaaacgattgtacgtagtatcagccgttggggaaattgtgagactgatatgcttttgtgaacagctattcagttggctaagttttttgaagtaagtttggatgagtttgtaggataaaatgttcttgacagaattctcgaattattttatactttaaatgcgtatgaacagattctatggcttagcgtttcgtaagtcgttctccctctagcagggggatatagcaagttactttagcttcctagaggtctagttgacttgtctgttgcattttgcgtaatgagttttcatacgcttttttattattcttaggagaaaacaatgaattatgaggatatacgctccagggacatgttagcttttgcccttgggattccaataaaacaattgacagggttgctatatggagtgaaaattgaaaattgttacactacatttacaattagtaagaaaaatggaagtgaacgtaccatcagtgctccaaataagagcttgaaatatgtgcaacgtaagctagctcgattgcttttaaaacggtacgaagaatttttaacagaaaaaaatactaaaaataggatatcacatgcattttttaaaggaaaaagtataaaaactaatgcattacctcatagaaacaaaaggtacgtacttaatgtagatttgcaagatttttttgattcgattcacttcggtagggtacatggtttttttaagaataatgatttttttaaattacctgatgtagcgacagtcattgctcaattaacttgttacgagggagtactaccacaaggagctccaacgtccccaataatttcaaatttaatatgtcaaatccttgactataaaataattgaactgtgtcaagaatatcacttaacatatacaagatacgctgatgatttaactttttcgacaaacgaaaaaaattttgacaataattatcaagattttctagacaaactagataaattagttactcgttctggctttaaaattaatgcggaaaaaactcactttcaagaatataatagaaggcaaacagtaacaggtctctcggtaaataagaaactaaatgtgaaaaaagatttttataaacatactagaagtatggcacatagtttatataaaactggaaaatttatgataaacggtaaagaaggcactctgaatcaattagaagggcggttttcttttattaatgacttggtgaagtacaacaacagattagaagaattaccatctctaaaattaaattcaatagaatacaaaaagaatttacaatttaccgatggaaaggaattcgaagtcaagaaaaatgagcagaaacagatactcgattggaaaaagaatttaagtactttatcaattagagaaaaagactatcaaaaatttattttttataaatattttatagctaatacaaatattactgtagtaactgagggcaagactgacagtagatatattaaagcagctcttcgaaaatactatgcagaatacccagagttagttactaaggaaaaagatgggttcaagtataaaataaattttttacctcgaacaaagaggatgagatatttcttcggttttttgtcaggtggtggatctgaccaaatccaactttttaattactttattaatcgggataaccatataagtcgtaattacatcaaatactttaaagaaatctctgaggatgtacctttgcctcaaaaacctacggtatttttattagataatgagtgggaaatcaaaaagcctctacataatataatcaaagtattgtgcaatgctcaaaatttaaatgataaagatatcattcaaaaaatacataccgattacttgtatcacgtagatttaaatgcctttttaatgacattaccagtagataatttaagtactaaatgtgaagtagaaattgaaaatttatttgatttggaaaaaataaatactgagctaattgaacctcttcacgatgggaagaaatttgatatcaaaaaggagcacggcaatgataaatccatagggaaagaaatttttgcaaacacaatattaactaactacgactctgaaattattgatttttcaaattttaagccattattagataaacttagcgacatatcaaaggattttacaaaatatacttaataacgagctaataggcagatataaagtttaaaggacaagcattattgattttactctaaaaaatctataatgtttgccctttagtattatatctaactctattactattttgtcatattaaacttcttaaactcatccttatatgctttactatcttttttgaaatattgacgttctgagcctgtaatactagcagtgataacatcattcttgtattcatattttaccgttggattgacgaatcctgaaatctcaaaggtttgtgtatcagtatcaatcgtcatgttactagttgaaacttcgacatcgacagttcccttgtcacccttaatggtgatgaccaggttggttccgtagtccccggtttcatagtattccccgtccatgataggtttacttgaacaagcgacgagaaagagagtggtaagagaaagagcaataaggctaagtaattttttcataaatatttcctcctagttggaatttattttacaggaatcgtgttacaaacgtgttaatgatagggtttcaatttaattgcgagacagatgcattagttgttaaactaattttcagtggacattcatccatttttttttatataattttagtcaaccaaatagttgacttataaatttgtgaggaggcgtactatgaaagacgtttatacaagagtaacccaaattgcaagagaacaactataccaattcatgaaggataatcaggtttcacccttaaattatcactttcattactattttgatgactgtatccaaaagtttgccattaaggtaatggagcatcactttaccaatcggaagattgagggattgacgatgatagatgaggacggtattttaatttcctatgaaagtcagaattcgcaagttaaacagtacttcactaagtgtcatgaactaggtcactatatcttgggacattcagggaagcagtttactcaattaaatggaaaaaaagatacgattgacgagagtgaagccaatcttttctctgcttatattctcatgcctgatattgtcttactatcaaaaatttattatcgcttggatagtttcaagcaagtaatgacagagctatccgtatcagcggatgccttggaatttcgattacaagatttattccgctatcgtttgaaacgaaacaatcaagagattaactcaactatttatcaatatcaatcaggtcaaagcaagtttgtcctcagtatttttgagaaagtccatactgagattgaagacgagtaccgagtggtgaaagaagatgtttttgctaaagttctgaatcgcctgagagagtgtcattttgtggcaagtacagagtttcctgagttgctagaaaatagctttcgcaaggaactagaacaagaagatgatattggtacttggttagaatatgactttggacagtcagtgggttacgcctggcgtacagataagttgaccacaaagcaagcaaaatcacgagtcaaaacaatactcctattagaaaagaggtagttatgtatcaacctgataaattaaaacaaaaacgagaagagctaggcttagagcaacaagaattggctgagcttatcggagtttcaaagcaggcttacttcaagtgggaaaaaggcttgtcaaaaccaactaaagtcaatattgctaagttggaaaaagtcttaaagattccagaaggctatttgagtgaagatgaaatctcatctctctataagcaactgacagagccaaatcaggagaaagctattacctacgttcgtgacctgttatcgtcacagaagattgttagcatttctgagaaacgttcagagtatcatgtttacgagaaactttctgctggtattggtgcctctgtttatggtgacctggactatgacgtggtttactacaatgaagaattaccgcatgattttgcttcttgggttgatagaaattcaatggaaccgacctaccagaatggagaagtagctcttatcatagagactggtttcgattatgacggtgctgtttatgctgtcgtctgggattcacagacctacatcaagaaagtctatcgtgaggaagaaggactccgcttagtgtcaatcgataagggttatcctgataagtttgcgccattcgatgagaacccgcgagtcgtaggaaagatcgtcggtcacttcatgccattggaggactagctatggggtattttgactattcatgagaaccaaaaagcgacatagcttttgtggatatgaaatccttctatgctagtgttgagtgtgtggaacgtggactacatccgttgaaaacctctctttgtgtcatgagtagagcggtgaatgctaacggcttgatattagcttcctcgccgatgtttaagaaagtgtttggtaaaaataacgttagccattcctatgacctgccttttgatattaagaccaagaaattcaactattatgtagcatgcagacaaggcctgcctataacctttgattatgtccgatttatcgaagagtgggctaggattactcatatcgttccccccctcgcatggacttgtatattgagaaaaacatggaaatccagtacattttccaaaactatgccagcccagatgacattctcccttattctattgatgagagatttattgacagtatttacatttttgattcttaattagactgtaatacttaagtaggagaattatttataaagatttttaaagaatagacaagataatgtggtaacttctaaaactaacttccagtttcccacaacctagcctttagtatgagaaaaacgcgtgaaatcagtagaaattcttcttagactaacgtccactggttttctttttttgatatataaaggttcaaaagagaaaagactaagaaaaaagtgcacgacaaatagccctaaaacagagtcgtcttagagtaacttccagttgctagcgtttagtgtgagacttttcgatggtgataagatgtgtagttagagaggaaaattccctttatttcaataaatcaggtgataagtgtgtgtcttctggtttgacaaattggcaccccagaagagcagcgatgtcctcgccaaagttgaaggtgaagacgttgtaagcagattttccttgaaactcttctcgtttcaaggaattgacatgggaaatgactagattgacgtctttctgagtcagctggtcaaaggaagtgcccttgggcagaatggctcgcaaaaccgtatggttcttctcaatccgccccttctggtcaggacggctagggtcgcagaagtagaggtgagacttaccatcaatgtctcgctcaagctcctccacataggagaactcagatccgttgtccgttagaatgacagggaacagctgatggaacgcataccctccgtccatgactctttctttcaaagctgcgaatttagtggcgacctccagagcagtcttgttgtccaaaagcaaggcgaagaggaaattgcagaaggaaacgttgaaggtgagcagtagctttccaccaggtctgccgatgaccgtatccatttccaaccatttgaagaaatcatctatttctcgtaactcttggaaatcttggtaggttcgcccaattttcagctctttgggaatagctacttttctggattttctgcgtgccttgaacttgaccatccgagggaaatcaatgggcttggttgttagatagcccagcttggcatgtcgatacaccgtagctttcgacacaggtaggttatgtgtctgaatgatatggtagatgctttgtttcttctggatgcctagggataagatcttgtccatctgataaaaacttttcttgtttaggggaatgccctctctggactccctcaacatagtcttgtactgttcctgggcctttttcgcgtagtaaagatagcggttaaagccacaatccgttctcttttttggacagttgttacagacataaggagcttttttgagaagtgggcaatccgtgcaatcagatttgacggatgttggatgcatgatgcgattgcgcttgatttcctttgaaatcgttgacgggtcttttctaattttctcagcgatggaacggaaagtctcctgttggctgattccagtttggatgtcaatacgttcttctagagtgagatgtttttgttttttcgtcatgaggttcctcctcacgaaaagtctcagacttaattctagcatcattcgtcgtctgagactaacttccagttttgggagagagatggaagttacttttagaagttacggacaagataatgtatctataacgtattagaaagttattgactaatagtcagtgattggttataataaaattgtatactttattacacggagatggtgtaaagtggtaaataacacatccaaatttggaagtcggtcacttaggaactaagtttaatgaccaaaggtgggttcgaaccctaccctccgaaagagttttgatttatgaaaactttttcgaagagtagggtttttgtttttggaggggaaatggcacaacagcttacaaaggaaaatttatatcaattctatactgaaaatattcgatatgcagattttcagttagatgttcttagacgtcaaataagaccattagcaggtgaatattattggtatatttcaaataataaagaaagtcaaattagaaaaaagcttatatatgaattgaaagcattgactaatctatacgcttatattttaggtagcagatttgaattacaattgatgaaaatattacatgaaaattcttcggtagcctttagtgaggctgaattacaaactattattaagagaaaaggtacaacatatgataaatggcataagtgcctagaaatcagttttcaaaaatcaacagatattgattggactgatgtgaatggacaaaatctattagagctctttcgagataagagtaattatttaaaagagtttcaggaatttataacgatgagaaatagattggctcatggtcagtggagtacacaattaaattctgatggaacaaaagaaagtactccagatgctttgaataaatacgatgatatatcaaaattagttttgttatcaaaaaaactagatacaatggttaagatagttgaaacaatagtagtatacagagaaaaaaataatgaaaagttcaaaaataagatatctaatttaattaaagaaaacaaaattatcgactgtagaatcaaaaatagtagccttaaaaaatatgtccaactagaaattaataagtttgataagaagaaaagtcgaaatagataataatttgaaattattaaaaaaatctggcattaatacggttcgcatatattctatttaagatcaatacttccaatatatcgtattagttttcgggaagtcaaaattttgttgttatttatgatatactaatgctacaattatatcctttgatgaggtaaaatttatggataatgtagtgagattacacttgaagactgggactgattctagacaggaattggtggatttctgtttaaatagtaaaaaacagtatgttgctattgggtggagtagtcagagtgaagatctctatcgtgagagttttcaagagtattatcaaagggttaaagaattatctggaagagctaacccagcaattaacgtttttagggatgcaaaagtagacgacttattctggacaagagatctagatggtagatactggatttgtagagttaagtcgcctgttgaagtagtatgtgataaacgattggatattggagcagtcttaccagttgaagcttataatttttgaatgcaagttcctggtcaaattaaatcgtccttcaataggccacgaggtggtactgttgaaagaattcgtgatagaataataattgagtattcgaaaacaatttttaatcaattatcaaacagtaaatattataaggttattccatatgaggataatcttttggataatctaccagattttgacttagaggaacttgtgatatcttatttgcaaatagaagagaactactatgttctatctaattcaatagcaaataaatctactacaattaagatcgagtgtgaaatgatttctagggaggttggcaactttaggaaagctgtggttcaggtgaaaggtaagaaagcgaaagtacttgatgctttagattttaaacaatatgttgaagagggatatatagtttacctatatgcaccgcaagtaattaatatagatcagattgacaatgtgattcgaatagataatgatgacctattagatttttacaagaaaaacaaacccatactcccattatcaataactcagtgggaaactctattcgggagtaataacagctaagttgtttacttgaaatttccctcattcaataaaacttatacaaattttttgaaataaaaaggcagttgaaaactatagaatattgattttacactatttttagtccaactgaaactcatactttccaaaccaggtcttaagaaagctcgtaaagcttcacaattctcaaaacgttaatcaatacgattatatcaacgtttcaaagcactttgcaaagattttgcaaagtgcttttttgtcgattttttagctcgattagctttgtgataaccttttctaaattttgattgcaaggctaggcgtgattaccttatttaatttctatcattttttattttgatgaagggtaacttagtttctacggaataacctttttcggtcataataaaacactcctgttcatagtttcactagatctaaacaggagtgttatttttgcgtctcaatttatgtgttcagtgcctatctacttttctagtaaccaatctataatgtttttcttctcaataccattgtaattggctgttggctgaatcgtatccattgttaatagatattttgggaattgatctttaatggcttctagtggtctaagttctctttctagtgtttctggagcaagtgttgtttcactgacttgataataagtgtagtgaccaagatcagttacaacaacaaaatcaacctcatatttatctaaattaccaacatatacttgtgaatatctacgtctcaattctaaatataccatattttccaagatatgcccaatgtcttctttgtggtctggtaataagagatgtcgtaaacctaaatcaacgggataatatttttctaagcgttgcaataatgctctaccttttacatcaaaacgtggaacggaataaaaaagcaaactatctgtcaaagtcgtcaaataattttccaaagtattatgggagattgaaacgttttggctgaccagggtattgcgaatcttatttgttgatattaagctacctgtactactgagaagggttcggacaatgcgttcaataatagtaggatttggatttcctaatctagttacaatatcatttaacagtattgagttatatattcctcttagataatcaattttttcagcgtaagatgatgtttgcaataagtaagggaaagcactaaagagataattgttaaaaatttctgttgtattcagattttctgtgagagattgacctgatagatattcttcaaatgacaaaggaagaacctctatctcaacataccgaccagtcaagtttgttgctaattggctgctcataaagtaggcgtttgatccagtcaaatagaggtcaacatttggtaggatgaatagactatctgctaccagttcaaatttctcaacatgttgaatttcatctaaaaagatatagtatgttttctcgctaactaattgatcttttatataagcgtataatgtttgaaaatgtcggaggtcatagtaactcagatcctcaaaattgatggatatgatttgatcctcgtctaccccagttgctagtaactcctctttatagagttgaaagagaacagatttaccagctcgtctaactccactcacaactttgatgatttgtcggtcacgatgtcttcttaaaaaatctaaataatgtggtcttttaatatagttcataatagatacctcaaagatagtataatacaaatagacattattttcaaatatttagaaataaattggaatttattttattatttctaaacatttaaaaataatctttttctataatcaaaaaatagtccattttggtatggcatgatagtaaatcttgtgaggttttgtagcaagtattcaaataaaaagcgcatactatcaggaataaaaaacttgatagtatacgttttatcctagaaatatttgctggctgtttttctcaaactgactttttaagaagttaccttatcagcaatttcaaataagtttatggagctatctttggaaaaactgtagaatttcaaaaattactacagaccttgaattttacttatcatttcaatgatttagattgcttacattttgttttgataagttttacggtaatctccaggagaaagtccagtcctttgtttaaaaattttagtaaagtaagaataattatcataccctacttgacaagatacttgtgatatcgagatatttgtttgagataggagagatttagcagcattaatgcgcttatccgttatatatttaacaagagtttctccagtttcttttttaaaaattctagctaaatgatctgcactgagataaacaacatctgctaagatagaacgatttatatcttcatagtagtgatgatctatgtattcgacgatgcgttgaatactatttttttggttttcaatgtttgttgcaaatttcttagcatgtgaccagtaataatcaaagtaatcctgaaaagattcaattgaatgaaagcgtcgttggaataagaaatcatgagtgctgttttggaataatttatgtgccgagattccattttgatctagatatattcctatttgttgagtccaatctagtaaaatttgttgtagtgtgaaagtaggtatttgagaattataagcaagtgaattaattttttctcttaattcgtattcacttaaggtatctaaaaaagtaattgaaagagtttctgttttaaaagaagttgggaaactatgtggaacacatgtaatagtattccaataagaaacatattgttcattataagtgtagagttctttggtatgaaataaaatatcggatattttatggcaactcttatatataatgtttgagtatttactaaagttattagaaatttgagaatgaatctcatatgctaatttgtcactacgttttgatgagtctactctaaaaagacaaacatattgatcaacctggctttccatcttaaacaaacttatcagtttataagaaggttgtgaaattctttgaagttctctttttagttgagaagtccatgatggagtttctacagaataatcttcttcattaagattaatggttaaaactgcgaggaaaaaatactggtgttgtttaagaataaaatcttgtttgctcgctatgttttctagttcatcaatgcgagaaatttgaggttttctaaggtaatcataccagaaattatcttctatttgtaaaagtgaatcattttttccatttaagttatgattctcaattttactaatggctttttgaataataaattctaatttttcaaagttaatgggttttagatagtattcaaagctttgcaattcaattgctttttgagcatagttgaagtcggcgtaattagttaaaaaaattgtttttatatcatatttttcatttctaatccaagataagagttcgaggccgctgccttgaggcatttctatatcgcttatcatgagatcaataggatgctctctaataatattttgagcttgagtgaggctataggcaacataaacaatgtcaatgtgtagtttagcccaatttattttctctcgtaaagcttcaatgataaaacgatcgtcatcaactaataagatgttcattataacctccgtctataatcttgtatggaatgagtaaaagaattttagctccaccttcttcattattttcaaatgcaatactatagtcattaggatagagaagatttaaacgttcgatggtgtttgttatcccgatatgatgtccatcttctgttattagagactgtttctgatttagttttgataaaatttcttcagagaaacctggaccattatcttcgatacaaatctgaatataatctgagtcctcagtttttactttttttattgatagtaaaattgtaaataaatcttgaaatgaaaaaccgtgtttgattgtgttttcaataaatgtttgtaaaagtaatgatggaacaagagtattttgtaaatcagaattgtagtctagtgaaaagtagatactatttccatatcgaatccgttgtatttctaaataatctttaatatgctgaacttcatctttaagttctgaaaaatcttgattagccataaataaatgacggagataatttgaagttaggatagttaattcttcaatttccttgtagttttttgtttgaagcatactatgaatcattgataacatatttaagtagaaatgcggacgaatttgatttttaagataattaagttctatcttcttaagttctagttgtgaatggtattcccgtatttttaattcttgcatgtcaaatattactttattaagtttatcatttgccttatcaatttctagtataccttcagatataaaaaattcagaaggggggatggagtccccaaattgagagagccgttcagtaagtcttgttataggtttaatcatccactgacgaatatacaggataatgatgattgataaaatggtgataatgataggaacagctgataaaaatacttctaagagtgtgatatttctaaagacttcggcataatcgactaaaacataaatatcgaaaggtaaatgtgttttttcattttgtgcatgaattaggtaattagaggacggtatattgttaggctcttttagggaaagtttaccattatttccaatattgagttttttgagaggttttaggatatcttctgaagatatgacggcataaatgatttttccttcgtaatgaacagatttaactaagtattcactgtttttagtagttacatttttccatttacggtcacttatatcactacgcaatgattttagatttgattttaacagtaaataatcttcatatggaatataaagattggagacatttataaaataatcagtactatcggtttctaataagaatgtcatatgagtttcattttgatattcaaactctgcaaagctagtttgaacttttttgagatcttcttgatagtcaagaaacgtttgtacatgatttaatttctctaaagattcattatgcgttattgttgagtacataaagcgttctacagaatgcaatttctcattaacagagtcagcataaatttcaattgaactacgtaggtgtactatattttggtttttaataaaatttctggttatgtcactcatagcaatattgattaaaatatttatcaatagtagtacaagtaggagtttaaagaaaaaatgaatagaatgtttttttgataagtcgtgatttaatttcatatactagtctcctattaaaattatagcactttgaaaatatgatatcatgtaacaaaacagatatgttttattaagatgtcggaaaagtaatagttcttaaaattaaaaaactgaaaaattgataaacctagtccaaaaagttatattaagggaattctttatggtgtaaaataatcgtagaaaatcagatgggaggaaaaacatgaaagtagcatctcaacttcataaaataaaattaaagcatagtattccgttatatatattactttttccttcaatattgctattaattttattttcctatattcccatgttgggactaattattgcatttaaagactattcaccagccaatggtatctttgctagtcagtgggtaggatttaagtactttactcaatttttctcatcattccaattcgggacaactatgttcaatacattaaaaatttcactttatagtattgtagtaggattccccttacctattatactagctataatcagtaatcagttaagagttgggaaatttagaaaaatatttcaagtgacaacttacttaccccattttatctctacaatggttatgtgtgggatgattatcttatttttatctcctactagtggtttgttagcgaatgtatttaagtctgttggaattactattccagatcttttatcaaaacctagtcattttgcaggtgtttatgtttggagcgatgtatggcaacatattggttgggatagtattatttatctagcagcgctttctgcaattgatcctacatattatgaggctgcaactatggatggtgcctctaggttacaaaaaattcggcatatagaattaccattgcttttgccgactgctatgattctattaatattaagagcaggtagtttattaagtgtaggttttgagaaagtgttactactacagaatcctcttaatttagcaggaagtgagataatttcgacctatgtttataaagttggtatggtgaactttcagtatagttattcgacagctatagggttatttaacacggtagttaatctaataattttgttatctgttaactggttctcaaaaagatataccagaacgggtcttttttaaaggaaggagtgctcaaggtgaaatggtttcataaatcaagaaaaacgaactctgaattattatttgatatagttacctatggtttagcaattttccttatcctgttaattgtttatccgttatggtttgtagtgattgcatcttttagtaatccttcagatgttgcaaatggaaaggtatggtttattcctagagaatggaaattagatggatatttacgtcttattcaacaacctttattcttacgtagctatctaaataccattttatatactgttgttggtaccttagttgctttagtagtcaatattccagctggttatgctttatctagaaaagaattagttggtagaaaatggatgagtattttatacataatccctatgttcgtatcaggtggcttgattcctacctacttaacagtaaagaatgttggcctaattgatacattttgggtaatggtaataccttttgcggtttcatcatacaatattattgttgctagaactttctttaataatagtattccagacgggatgtgggaggctgcgcaaattgatggatgtggtacaattcgttattttattaagatagtcgttcctttatcaaaagctattatagcagttattggactttggactgcagttggtatttggaattcgtggtttaatgctttaatttatttaacgaatgaaaatttacagccattgcaattaattttacgacgtttactaattagtaatcaaatgttacaatcgcaagcaacaggagaagtggcatcagatcttcgtatcaaagccgatatgatgaaatatgcagcaattgttatttcaaccgctccgataatgttgctatatccctttgttcaaaaatattttaatcaaggcgtaatgattggtgccttgaaagaataggagaaaaacatgaaacataaatcatttacatatttgttcttaggaaccgttacacttgctggcttaacagcctgtgcaaattccaataatgcgaataaggacgataagtctggagaagattcttataaaatcacaactgttcgttggtctgactggggagaagattatcataaaggttttctaactgattctgccaaagaatcaggtatcgatgttaaatgggatacacttgtagctgcagattgggcagataagaaatctgtgttggttgctagtggagatttaccagatgcatttttaggttcaaatgcttttacagattcagaaattgctcagaatcaatctttatttattccattggaagatttaatcaaagaaaacatgccaaatttaactaaggctatggagaaagaacctaagattaaagctatgattacttcaccagatggtcatatctacagtctacctaaaaaattaccgatgcgtcctactgtagctaatcagctatttattaataaaaagtggctggataatttaggattaaaggttccagaaacttatgatgatttagtaaaagtactacaagaatttaaggataaagatgcgaacggaaatggagacgcttctgatgaaattccattcggagcaggaaactttgatccaacattctcatatattcttccgttcaataatcgtttaggggcagataatacatatgaaatgtctgtaaaagatggaaaaccagtctaccttcgtacagaagaaagttataaacaagggattgcagcaatgcacgaatcttataaaaaaggtttgattgatccggaaatctttacagaagatacctctatgagtgtagcaaaacgtatggataagggagtatctagagtaggtgtttctagtggttggacagcagatgcaacgtttggcttacattcaagtgagtatattgctctacctgctttaaaaggtatggatggtaaacaatatgtcttttctgatccagatcattacaactacggtcgaaatgaaattttgattacaaataagagcaaaaatcctgctaaattattgaaatggttggataaattatatacagatgaagcaagtattcagaatttctatggatcatttggaatagctactgaaaagaatggtgataagtttaaagtgttacctcctaaagatggtaaatcagctgatgaatgggcatggattaattcacttcgagattttggtcctaaatacgtaagcgatgatatcaatagtcgcgtagaaatcgatcaaacacaaggtgatggattgaaattgaagatggaccaagatttgaaacaatttgcgttgccagcttaccctaatgtgatttattcacaagaagagcttaacaaattatcatcaatctatgttagtattgaatcttatgtcaaacaacaagcatctaaatgggtagttgaaggcggcatagaaaaagaatgggactcatacaaagaaactcttaagaatatgggattggacgaatttatgaagattcaacaggaagcatataatcgttaccaaaaagaagtaaaagagtaatactttatatgaactcttggttgtataaacaagggactagctaattacaggaagcgagactgataacatcaaattatctcgcttcctttattctaatttttaaagaaatttagaaatgttttttaaataatttaggtaatatttttgtgcaactgacattctaaagtatagagttaagacgattgattttatggagatatctattatgcaaaaattattttcattagatggaaaagtggttagaattttaacttttttgacagatttaattattttaaatactctatttattgttagttgtattccaatagttacaattggggcatcattaacttctcttacgacaatgtggtatcgtattttaaaaggtaaagataccgatattgcttatcattattttcggatctttagacgaaattttaaacagtcaacttttatttggttgtttatcctcctaatagaattacttttatatgtgaactattgtctttggggctattcaagtttattttcagagtatagtttattgttagtgttgccctttttatttgttataatacttttgatgagtgttatttttccctatattggtttatttaaagataatctaaaaaatagtattgtaaatagcgtattaatttgtattttaaatccaatacaagctatcatgttggttttatttaatatttctgtactgtatatgagttttagtagtccagaacgagttttaacagctatttacgtatttacatttgggggctttgctttttgcggattgatgaatgtaacgataacaaataaaatgtttgataaggtaaagaaatttactaaaaggaggacaacaaattgaaaatttttaagggagagttttatcgaatctctgtattaacagacaagctagtaaggttagaatactctcaaactggaagttttgaggatagaacgacacaacttatctacaatagagattttggccaagtttcgttagattatatcgagacatcaaacgtactagatattatgacggactattttcatctgcactttaataaaggagaatttaacgccgaaaatttatttatagaattaaaaggaaattttgccgtatatggtagtcgctggtattttggtgagtctattgaaacgttaaaaggaacagctcggactctggataaggcagatggagcaatctcgttagaagatggaattattagccgaaatggtatagccttattggatgattctcaaggatttatttgggatgaacagtctggttatattgagagagaaaatcaaattgacctgtatttctttgcctatgggcatgattatagaggagcaatcagagacttttaccatttgactggttcaacacccttgttgccaagatatgctttagggaattggtggagtagatattggccttatacgtcggatgaatacttggatttaatagacagatttaaagcagagaaaattccattatctatcggtgtgttagatatggattggcacataactgacattccagctcgttttggaagtggctggacaggatatagttggaatagaaacttaatacctaatccagaacagttattgcaacaacttcatgataaaaagttaaaactctccttaaatgtccatcctgctgatggtatacgagcttatgaagaagcttatcctcaagtcgcaaaacgattggggttaaatgtagaactagaagaacctgctatttttgatttttttaatccctcttttagagaagcctactttaaagatgttcattataagctagaaaagcagggagtagatttttggtggattgactggcaacaagggacacaaggcatgttggatccactatggcttttaaaccattatcactatcaggatagttgtaaaaattcagaaggtggcttgattttatcaagatatgcaggtcctggtagtcaccgctaccctgttggtttttcaggggatactattattagttggaattccttaagatttcaaccttattttacagcgacagcatcaaatatcggttatagttggtggagtcatgatatcggtgggcacatgctgggggattatgacgaagagctacaaactagatggctacagtttggcgtttttagtccgataactcgattacatagttctagaagtccctttaatagtaaagaaccttggtttttttcagaaacaacatctaagattatgaagaaataccttcgtttgagacatcagatgattccatatctatataccatgaatgtaaagacacatgaggaaggtgccccattaatcagcccaatgtattatttctacccagaaaatgatgagagctataatgttccaaatcaatacttttttggaacagaattgatggtggctcccattgtagaaaagatggatttggcattccaatctgcaaaagtagatgtatggttccctgaaggtgaatggtatgacttcttttcagagaaaaagtacacaggtggtgtgaacttaagtgtttatagagatatttcgactattcctgtgtttgcaaaaagtggtgcaatcattcctttggttggttctgagatagatatgggtgttgatttacctgaagttgtagattggtatgtattcccaggaaaacaacattcttttgaaatgattgaagatcaaaatggtcaaagatataaaacaagattatcaatcaactgggaaatggggatggtagagttaacattacaaggagattctagtatcgttccaagtaatagaaaacatagaattcattttaaaggaacgaatgtgtctatgattgaattgccaaataagaatgatacagctagatttgaatgtaaagataataaaaggatatccctaaatgatgaagtttttagactactaaagacggcttttcttccatatgaattaaaagatagattgttaaatcaattcatcaatgctaaaaattctcatgacttaatgaatatcttgcatcatcaggataaggaattgagagggcgtttgttggaaaagatatttactagcgaaaactaattgagaaatttcgtacacaatttctattatttaatgtgtaacagttttacatctctatgcttattggcttgtattgtagtaactacaagtttggcatagggatttttgtttactgaagaggaaaggataagtatgtttcaaggtttgaaatatttttaaactaaacaagagcaaatttttaaaggagatttttcaacgtaacttccacttgtctgaccgaagtggaagttagtctgaaatttatggtggaattaagtatgagacgttagattttttcagaaaattttctaaaacaaacaggatttgtttgacatttatttgaaaattctgtaaaatgaattattatatcgttaaaggagaatatatatggaaaaacagaaaacattttttggacatcctatgggcttgtccaccctcttctttacagaaatgtgggaacgcttttcttactatgggatgcgagctatcctactttactatatgtactatagtgtgcaagatggtggattgggaatggataagaccacagctgcatcggttatggcgatttatggctcgctggtatttttgtcctcggttatcggtggttttgtcagtgaccgtattttaggaagtcgtaagactgtcttttacggtgggattttgattatgctagggcatattgctttagcaacaccttttggacaagtggctctctatctttctattgccttgattatctttggtactggatttttaaaacccaatatctcagatatggttgggggaatttatgagaaagaggatgatagacgggatgcaggttttagtatctttgtctttggtattaacttaggtgccttcgttgccccttatttagtaggttatctaggtcaggaagtcaatttccatctaggtttctcattagctgccattgggatgttctttggtttggtgaagtatgttttggatgggaagaaatatctgcctgaatcaagtctttaccccactgatccactttcacagaaggaccagcagaccttgattaaacgcttgctgattacacttgtcgtagttattctcgtggttataggtttagtctttactcaccagtttaatgtggatatgattgttaatatctttacagtgattgctgtaattattccaatctactatttctttaagattttatctagtcagaaaataactgccactgagagatcccgagtatttgcctacattcctctatttatcgctggagtactcttctggtctattgaggaacagggttctgttgttctcgctctatttgcggatgatcaaactcaactttactttaatgtatttgggaatcagattcattttccatctagctttttccaaagtatcaatccccttttcattatgatttatgtgccgatttttgcgtggttgtgggggaaaatgggtaaaaagcaaccatcctctgctaagaaatttgcttacggtttatttgctgcaggtttatccttcttgtggatgatgttaccagggatgctctttgggacagatgttaaggtcagtcctctctggttgattatgagttgggctattgtgattgtaggggaaatgctgatttcgccgattggtctatcagtcactactaagttagcaccaaaatccttccaagcacaaatgatgtctatctggttcttgagtaatgcagctgcccaagctatcaatgctcaaattgtaaaattttatacaagcgaaactgaagtggcttactatggaattgttggaggaattacgattgtattcggtattatcttactcttctacgttccacgtattgaaaaactaatgtctggtatcaaatagagaaaaactggaatttctgtaggaattttaaaagttagatcaattatttattcaaaggatttagttctgtattgtatagggctaggtccttttagtttgattaatactcttcgaaaatcaaattcaaaccgcgtcaacgtcgccttgccgtactcaagtacagcctgcggctagtttcctagtttgctctttgattttcattgagtataaaactcacgatgtttctgcttttcctagtggacatttgtctactttttttatataataaaactaaaccaaattggttgagttttaaaagtgactcaactaaagattagcttttctaaggaaaatcatttaagataaggttctatactaggaggtgaagtatgtatcagccagaaaaattaaaggctcggaggaaagagttaaaactgacacagaaggaaattgcagagcaacttgggattagtttccaagcttactcagcttgggaacgtggaatcaaagaaccgtctaaggagaaggtgtttcagctagagaatattttaaaagtgccaaaaggatattttactcagatcgagattgtccgtctctaccatagcctctccaagcaagggcaggagaaggttgttctctatgctcgcaacctatctcaagaggagcaagcccacaaagtgacagctatgccagagcgcctctacgagtaccgtgtttatgaacgcatgtcagcagggattggggcttcggtctacgatgatcagaattttgatacggtttactttaatgaggagttggctcatgattttgcgtcatgggtgtctggggactccatggaacctaaataccaaaatggttcagtagctctgattcgagagacaggatttgactatgacggggcggtttatgcagtggtttgcaacaaccagacctatatcaaacgggtctatcgagaggagaatggattgcgtctggtctctatcaatcctaaatacaaggatattttcatctcctatgaggaagatcctcggattgtggggattatcgttgggaactttgtgccgatggagggctagccaatgggctactttgattattccagagagcccaaaagtgacattgcctttgtcgatatgaaatccttttatgccagtgttgagtgtgtgaaaagaggattgcatccgctgaaaacctcgctttgtgtcatgagtcgcgcggataattcaactggtcttatcctagcctcctctcccatgtttaagaagatttttggccagtcaaatgttggtcgggcctatgatttgccttttgatatcaaaacgcgaaaattttcctattacaatgctcgaaagcaagggctaccgactgactcggactatgttcgctacatcgaagattgggctcaagtgaccttgattgtccctcctcgaatggacgagtacattgcagtcaatatggaaatccagcgaatctttcaaaactatggcagtccagatgatatttatccttactctatcgatgagggctttattgacctgactagttcgctcaactattttatcccagataagagtctctctcgcaaagacaagctggatatgctttctgctcgtattcagagggatatttggaggcagacagggatctactctacagtaggtatgtcaaatgccaatcccttactggccaagttggctctggataatgaagccaagcacactccgaccatgagggccaactggtcttaccaggatgtggaagagaaggtctggtccattcccaagatgaccgacttttggggaattggcaggcggatggagaaacgcttgcatgctctggggattttttccatcaaggaattggcaaccagcaatccagaccagctaaagaaagctctgggtcaggctggtctgcgtttgtggtttcatgctaacgggattgatgagagcaatgttcataagccctataaagccaaatccaagggcttggggaattctcaaatcttgccgagagactacgtgaagctacgggatattgaaattattatccgagaaatggcggagcaggtagctattagattgagaaggtctggtaagaaaacaacccttgtctctatctatgtcggtttctcgaaacaggaggtcaggtcgtctattcacacacaaatgaaggtcgaaccgaccaataatacagctgtcttaacgggttatgttttgaagctatttcataacaaatacacttctggagcggtcagaagtgtcggagttaactattcaggctttgtagacgagtcctttggtttgatttccctttttgatgatgttgataagttagaaatagaagaaaggctccagacggccattgactccattcgggaacaatttggtttcacttctcttttaagagccaatgcactggaagaaggctctaggagccttgccagaagtaagctgattgggggacattctgctggaggattagatggattacaatgatttattgttcttattcaccttttcaatctgcgcgagattatcaaaatccaggtatgcagaaatggatgggattttacctttcagaacacaccagttcgcttagtgaagaaaaaatcgtgttgatttttcgatagatttggacccagttgagaaactacatttactttctcagctttatgttggccaacttaagggaagtttttctatttaagtcaaagcccatcaaaaaatctcactattcattaggctaaaggaaacctaatcatagtgagattgtgaattatagtaatttttgtatggcctcttcaatttgttttgggtctgtttttgaagagaagcgttcaaaaacctgcccatcacgactgatgagaaatttagcgaaattccattcgattcgttttcctagtggaccagatttctggtctttcaaccagacatagaggggatctgtttccttgccgttgaccttgatcttggcaaaacgtgggaagctggtctggtaatgtaggctacagaaggcgttgatttcctctgcgctacctggtgcttgtcccataaactgattgcaagggaagtctaaaatctcaaaaccttggtcttgatagcgatcatagagttcttgaagtccttggtactggagcgttaaaccacatccagtagcagtgttgacaaccaaaataaccttaccacgataggcatctagtagagtttcttgcttgtcttggttcaagactgaaaaatcgtatagtgaagtcattgcttgcttttctccttctgtttggtatttttaggagttttctcctcctgtagtgatagaaatccgtaggtcagggttccaaaaatgcttccgataatcaggccatacatcaggaaaggaacacttttatcgaattgcatgagcaatttcacaaaatctgaaagggacatctgctgaacgaagactttatgaaagatgagtaaggtaaagaagccaatctgaatactgataaacacaatccagcttcggaatttgatttgggctttgctgtaggttttgaggatgatttctgatttgtcatccttttcaagatgaagctcttggacggctttttgagcttttatactcatgaacaaaatgagtccaaaatagatgtagggcataacatttcgaacaatttctataaagcttccgaacaaaatatagaataggaagagaatgaaggaagagtaaaagatttggatcatggaacgggcgcaagccttgtagataacctcttgacggcattcatcaaaaggcccttggatatgaaagaaatttcgaagtaggcgagttgttaagtcttcttttttcatgggtgatttctcctaaatgaacgatgctattttgtttcttttacgaattgatagagataataaagataagtaatagaagaaaggatagcgatagtgagcagtaaataataattccaattgcctgagacgagcatcagttgtggaaaagatagaattataaagtatagtgctaagttgagtatgcgtgtttttggggagttaatctttagataagttagtcctttattaagtcctggaaaaaagactagcacgaggaatatctctctgattggcaagttccctgaaacgatgatgaagatgagcagagaactgaacaaaagatgataggtaagtaaagttactagtgatttcatagggcacctcctaatcctcatcttgctcttttttagtttttgcaatgcgacgggaaatgaggaactgtatgcttgctccgaagaagatagaaccgagaatgcttgatacaccatttcttatagtgagaagagaattaaaatagtccggactttcacctatgagtatactgagaagaggagttataaaaaacatccatagaccaaagaacaaacctgctttaagacctgggtagtatagttgcttgctttctttctcattcagcatatctggatcaatagctgtaatccctgtttttttcatttggtaggtgacatagccagcagcgatgagggcaatcactagaatcagaggaggatagattagagccacttcttgagggtatttataggccagaaggagtggaataagatttccgaaaatcatcagataaaagaggatgataaagacttggttcccaatacgatcggcctcatgccgtttgtattcgtcaaggggaccagaaataccgtatgtgcgtttgatcagtttttcagtgaaggtttcttttttcatgagttggctccttttttaaaaatcatcctcccaaaagagactgttgaggtcagtttggaggcttcgggcgagattgagacagagttccagagttggattatacttgtcgttttcaatcatgttgatggtctgtctcgagacgccgatatccttggcgagttcgagctgggaaatgcccagttccttgcgaaattctttcacacgattcatttgttctcctttctgatttgtgtcgtatatatttgactatattatattcttctaagaaatagatgtcaagcatatttgacatatttcttaaagaaatcttacttgtttttgccctatttgtctgactagtgcaagctggtcggatttatggtaaaatagataggatatgacaaaagaatttcatcatgtaacggtcttacttcatgaaacgattgatatgctcgacgtaaagcctgacggtatctacgttgatgcgactttgggtggagcgggccatagcgaatatttattaagtaaattaagtgaaaaaggccatctctatgcctttgaccaggaccagaatgccattgacaatgcgcaaaaacgtttggcaccctatatcgaaaaagggatggtgacttttataaaggataacttccgtcatttacaggcacgtttgcgcgaagctggtgttcaggaaattgatggaatttgttatgacttgggagtgtctagtcctcaattggaccagcgtgagcgtggtttttcttataaaaaggatgcgcccctggacatgcggatgaatcaggaagctagtctgacagcctatgaagtggtgaaccactatgactatcatgacttggttcgtattttcttcaagtatggtgaggataaattctctaaacagattgcgcgtaagatcgaacaagcacgtgaagtcaagccaatcgagacaacgactgagttagcagaaattatcaagtctgccaaacctgccaaggagctcaagaagaaggggcatcctgccaagcagattttccaggctattcgaattgaagtcaatgatgaactgggagcagcagatgagtccatccagcaggctatggatatgttggctctagatggtagaatctcagtgattaccttccattcactagaagaccgcttgaccaagcaattgttcaaggaggcttcaacggttgaagttcccaaaggtttacctttcatcccagatgatctcaagcccaagatggaattggtatcccgtaagccaatcttgccaagtgcagaggagttagaagccaataaccgttcgcattcagccaagttgcgcgtggccagaaaaattcacaagtaagagggaaaaatggtagataagaaagaaacaaccagtcaattcttgcagaatcgtataaaaaaattctcacgtgtggagaaggctttttatctttccatcgcttttacggctctcgttttagcagtgagcatcatctttatgcagacacgactcttgcaagtgcaaagtgatttaacaaaaatcaatgcgcagatagaggaaaagaagacagagctcgatgatgctaagcaggaagtgaatgaattgattcgttcagagcgcttgaaagagattgcagataaaaaagatttgaaattgaataatgaaaatatccgaacagcggagtaagatatgaaatggacagaaaaaataacccgatttgcgataaaaaatcgtaaatctccagcaaaaaaccgtaggatagttggtaagtacctcagctttgtagctgttgcccttttcgccctctttttggccaattttgcgtatattatcgcaaaaggtaatatatttggtactgacttggtaaaagaggctaaaaaggttcaccaaaccactcgaacagtacctgccaaacgcgggacgatctatgaccgaaatggagtgcctatcgctgaagatgcgacctcttataacgtctatgctgttattgataaaaaatacaagtcagcaacgggtaaaattctttatgtagaggattcgcagtttaataaggtagctgaagtcttccataagtatttggatatggatgaagcttatgtgaaagagcaactagctcaaccaaatctgacccaagtttcctttggagcaaaaggaaatgggattacctatgccaatatgatggctattaaaaaagatttgaaagatgctagtgtggaagggattgactttacaactagccctaatagaagctacccaaatggacaatttgcttctagttttattggtttagcccaactccatgaaaatgaggacggcagtaagagtttattaggaacttctggtctggagagttcgttaaataccattcttgctgggacagacggaattattacctatgaaaaagaccgtgtaggaaatatcgtaccaggtacagaacaggtgtcgcaacaaactgtggatggtaaggatgtttatacaacattgtctagcccgctccaatctttcatggaaactcagatggatgcctttctacaaaaagtaaaaggtaagtatatgaccgcgaccttggtcagtgccaagaccggtgaaatcctcgctaccacccaacgacctacctttaatgcagatactaaagaaggaatcactgaggactttgtttggcgtgatattctttatcaaagtaactacgaaccaggatcaaccatgaaggtcatgacgttagcttcttctattgacaacaataccttcccaggtggagaatacttcaatagcagtgaattaaaaatagcggatgcgacaattcgagattgggacgttaatgaaggtttgaccggtggtggtatgatgacattttctcaagggtttgctcactcaagtaatattgggatgacccttcttgagcagaaaatgggtgatgctacgtggttggattatctaaaccgctttaaatttggggttccaactcgttttggtttgacagatgaatatgcaggccaacttccagctgacaatattgttaatattgctcagagttcatttggacaagggatttcagtaactcagacgcaaatgattcgtgcctttacagccattgccaatgatggcgtcatgctagagcctaaatttattacggccttgtatgatccaaatgatcaaaccgttcgtaaatctcaaaaagaaatcgtaggaaatcccgtttcgaaagatgcagctagccaaacccgtactcacatggtcttggtaggaacggatcctagatatggaactatgtacaatcatagtacaggaaaagcaactgtcaatgttccaggtcaaaatgtagccctcaagtctggtacggctcaaatcgctgacgagaaaaatggaggctacttggttggttctaccaactacattttctcggttgtggctatgaaccctgctgaaaatcctgattttatcttgtatgtaacggttcaacaacctgaacattattcaggtatccaattgggagaatttgctaatcctatcttggagcgagcttcagctatgaaagaatctctcaatcttcaatctccagctaagaatttagatcaagtgactacagagtcttcttatgcaatgcctagcatcaaggatatttcacccggtgatttggcggaagccttacgccgaaatattgtgcaaccaatcgttgtaggtactggaacaaagattaaagagacttctgtagaagaagggaccaatcttgcaccaaaccaacaagttctccttttatcggataaggtagaagaaattccagacatgtatggctggaaaaaagagactgctgagacctttgctaaatggttggatattgaactggaatttgaaggttcaggttccgtcgttcagaagcaagatgttcggactaatacagctatcaaaaacattaaaaaaattaaattaactttaggagactaatatgtttatttctatcagtgctggaattgtgacatttttactaactttagtaggaattccggcctttatccaattttatagaaaggcgcaaattacaggccagcagatgcatgaggatgtcaaacagcaccaggcaaaagctgggactcctaccatgggaggtttggttttcttaattgcttctgttttagttgctttctttttcgccctatttagtaatcaactcagcaataatgttggtatgattttatttatcttggttctttatggtttaatcggatttttggacgactttctcaaggtcttccgaaaaatcaatgaggggctaaatcccaagcagaaattggctcttcagcttctaggtggtgtcattttctaccttttctatgagcgtggtggcgatatgctttctgtctttggctaccaagtgcatctagggattttctatattgtcttcgctcttttctggctagtcggtttttcaaacgcagtaaacttgacagacggtattgacggtttagctagcatttccgttgtgattagtttgtctgcctatggagttattgcctatgtgcaaggtcagatggatatccttctagtgattcttgccatgattggtggtttgcttggtttctttgtctttaaccataagcctgctaaggtctttatgggagatgtgggaagtttggctctcggtggaatgctggcagctatttcaatggctctccaccaagaatggactctcttgattatcggaattatttatgtctttgaaacaacttcggtcatgatgcaagtcggctatttcaaaatgactggtggaaaacgtattttccgtatgacgcctgtgcatcaccattttgaacttggaggattgtctggtaaaggaaatccttggagcgagtggaaggttgacttcttcttttggggagtggggcttctagcaagtctcctgaccctagcaattttgtatttgatgtaagaatggcaccctgatgtttcagggtgtttttgctttttaaaaaatattggtcaattaaagtcaaattccttgaccttttttgactaatgtagtatattatgaacgtaaggtaaatgaaagccttactagaacacttatttaaagtaaaatagaaagaggtggggtctatgtttaatctagaaatctttagaagtaaagatagtctactcctgcttgaaaaagaaaaaccagaaatagtacgtagagtagcgatttagctagtctaaattttttaaagaaaaagtcaaagatagtcaatatcagtaataataaataacaaaaagaggtaaagaatatgaacaacaactttaataattttaacaacatggatgatttatttaaccaattgatgggtggtatgcgtggatatagttcagaaaaccgtcgttacttgattaacggccgtgaagtaacgcctgaagagttcgctcactatcgtgcaactggtcaattgccaggaaatgcagaagctgatggacaaatgaaacaacagtcttcaggtatgaaacaagacggtgtccttgcaaaactaggtcgaaacttgactgcagaagcacgtgaaggtaagttagatccggttattggacgtaataaagaaatccaagaaacttctgaaattctttctcgtcgcacaaagaataatccagttctcgtcggtgatgctggtgttggtaaaactgcagtagtagaaggattggcccaagctatcgtgaacggtgacgttcctgcagcaatcaagaacaaagagatcatttctattgatatttctggacttgaagctggtactcaataccgtggtagctttgaagaaaacattcaaaacttggtaaacgaagtcaaagaagctggaaatattatccttttcttcgacgaaattcaccaaattcttggggctggtagcacaggtgatggtcaagggtctaaaggtcttgctgatatcttgaaaccagctctttcacgtggagaattgacagtgattggcgcaactactcaagatgaataccgtaatactatcttgaaaaatgcagcccttgctcgtcgtttcaacgaagtgaaggttaatgctccttcagcagaggatacttttaaaatccttcaaggaattcgtgatctctatcaacaacaccacaatgttattttgccagatgaagtcttaaaagctgccgttgattattctgttcagtatattcctcaacgtagcttgccagataaggctatcgaccttgtcgatgtaacggcagctcacttggcagctcagcatccagtaacagatgttcatgctgttgaacgtgaaattgaggcagaaaaagacaagcaagaaaaagcagttgaggcagaagattttgaagcagctctaaactataaaacacgcattgcagaattggaaaagaaaatcgaaaaccatacagaagatatgaaagtgactgcaagtgtcaacgatgtggctgaatctgtagaacgaatgaccggtattccagtatctcaaatgggggctacggacatcgaacgtttgaaagatatgggtcatcgtttgcagacgaaagttattggtcaagataaggccgttgaagcagtagcaaaagctatccgtcgtaaccgtgctggttttgatgaaggtaaccgtccaatcggtagcttcctctttgtaggtcctactggtgttggtaagactgagttggctaaacaattggctctagatatgttcggaacgaaagatgctatcatccgtttggacatgtcagaatacagcgaccgcacagccgtatctaaattgattggtacaactgcaggttatgttggttacgatgacaacaacaataccttgacagaacgcgtccgtcgcaatccatactcaatcgtccttctcgacgaaattgaaaaggctgaccctcaagtcatcacccttctccttcaagttttggatgatggtcgtttgacagatggtcaaggaaatacagtaaacttcaagaacactgtcattattgcgacctcaaatgctggatttggctatgaagccaacttgacagaagatgcggacaaaccagaattgatggatcgtttgaaaccttacttccgtccagaattccttaaccgtttcaatgctgtcatcgaattctcacacttgagcaaagaagatctttctaagattgtagaccttatgttggttgaagttaacaagacgctttctaagaaagacattgacttggcagtgagcgaagctgctaaagaatacatgactgaggaaggctacgatgaaatcatgggtgttcgtccactccgtcgtgtggttgaacaacaaatccgtgacaaagtcacagacttccacttggataaccttgatgctaagcacctagaagctgacatggaagatggtgttttggtcattcgtgaaaaagcctaaatcaagattttgaaaataaaaaaaggaaccagttcaaaagctggtttcttttttattattagatgacatgacgttcaaaggcatcgtcagagattccttgttggagaatcaattttgcccattctttagctgaaaagaggctgtgatccttgtagttaccgcaagattcgatggttgttccagggacgtcttcccaagtagtagtctcagcgatttccttgagcgaatccttgatgacggccgcgatttcagcactggtgtggcgcccccacataatcatatggaagcctgtgcggcaaccaaatggtgaacagtcaatcatgccgtcgatgcgggtacggatgagcttggctaagaggtgctcaatagtgtgaaggccagcggtagggatagagtcttcgtttggttgcactaaacgaatatcataattggagatgacatctccctttggccctgtttcttccccgatcaagcgaacatagggtgctttaacaatggtgtggtcaagttcaaaactttcaacaataacttcttttgacatggtaaatcctttcagttttctaatttcattataacataaagccagctcttgagacagagagaaaacctctccgaggctggagaggttgaaatctttatttacgatacaagcggtcgtattggtagtaagggtcaaaggttacattgatacccaatttgcgaaggacattcttgtcttcatcggttaagatgatggttgagtgggcttcgcttcctttgaggttgccaagttcttccatagcacgagcagcatcaggattttctgtagctgtgatagcaagtgcaatcaggatttcatttgaatgaaggcgtggattgcggctaccgagatgatcgattttaagaccttggattggcttaacaacttcaggttcgattagttttacttctttagcgatgtcagctgatttcttgatagcgttgataagagcagcggctgtagggccaaagagctctgagttcttacctgtgacaatttctccgcttggcaattcaagggctagggctggtccaccagtttcttctgctttttgacgtgcagcaacagcaaccttacggtctgctggtgtgataccgaggtcattcataagcaactcgattttcttgacagctgcttcaccaactttttcggctttaaaatcaagaacagtttgatagtagcggcggatgatttcttgtttagaagcttcgacagcagcttcatcatctgtaatagcgaaaccaaccatgttgacacccatatctgtcggagaagcgtatggagatttaccaaggatacgttctaacatgcgcttgagcactgggaaaatctcgatatcacggttgtagttgacagtggtttctccgtaggtttggagatggaaggggtcaatcatgttgacatcatcaaggtcagctgtggcagcctcgtaggccaaattgactgggtgatgaaggggaagattccaaactggaaaggtttcaaatttagcgtaaccagacttgataccattgatttggtcgtggtacatattggacatacaggttgccaattttccagaaccaggtccaggagcagttacgacgatcaagttgcgactggttttgatgtagtcattttttcccatgccttctggagaaatgatgtgatccatatccgttggatatcctttgattggatagtgaagataagaatcaattccgtttttctcaagttggttgcggaaggcatctgcagctggttggccagcgtactgtgtgatgacaacggagccaacaaaaattcccagttcattgaatttgtcaatcaaacgaagaacttcttggtcataagaaatgcccaagtcaccacgtgctttggaatgttcgatgttgttagcattaatggcaattacaacctcgacttgctctttcaattcttgcaagagcttgattttgttgtcaggctcataaccaggaagaacacgagcagcgtgaaaatcttctaacattttgccaccaaactccaagtagagcttgccgtcaaattggttaatgcgctccaaaatgtggtcgcgctgtagattcaaatattgttcagaactaaaagcttgttttttcatttttttacctctgacctctattataataaaaaaatggaagttaggaaactatggagttaaaaaaggaatcaaaaagattaggcaaacgcttgcataaaaatctgaaaagcgctatcatagactgtagattattaaaataatgaggtaagaagatgcaagaaaaatggtggcacaatgccgtagtctatcaagtttatcctaagagctttatggatagcaacggagatggaattggcgatttgccaggtattaccagtaagttagactatctagctaagttaggaatcacagcgatttggctttctcctgtttatgacagtcccatggatgataatggctatgatattgctgattatcaagcgattgcagctattttcggaaccatggaggatatggaccaactgattgcggaagctaagaagcgtgatattcgtatcatcatggacttggtggtcaatcatacctcagatgaacatgcttggtttgtcgaggcctgtgaaaatcctgatagccctgagcgagactactatatctggcgggatgaacctaacgatttagattctatctttagtggttctgcttgggaatatgatgaaaagtcgggtcagtactatctccactttttcagtaagaaacagccggatctcaactgggaaaatgaaaaacttcgtcagaaaatttatgagatgatgaacttttggattgataaaggcattggtggtttccgtatggatgtcattgacatgattgggaaaattcctgacgagaaggtggttaataatggtcctatgctccatccttatctcaaggagatgaatcaagcgacctttggagatcaggatctcttgacagtaggggaaacctggggagcaactccagagattgctaagctttactctgatccaaagggccaagaattgtctatggtcttccagtttgagcatatctgtcttcagtatcaggaaggtcagcctaaatggcactatcaaaaagagctgaatatcgctaagttgaaagagattttcaacaaatggcagacagaattaggagttgaagatggctggaattcgcttttctggaacaatcatgacctccctcgtatcgtctcaatctggggaaatgaccaagaataccgcgaaaaatctgccaaagcctttgccatcttgcttcatctcatgagagggactccttatatctaccaaggtgaggagattgggatgaccaactatccgtttgaaacactggaccaagtagaagatattgaatccctcaactatgcgcgtgaggctcttgaaaaaagtgttccgatggaagaaatcatggacagtatccgtgtcattggacgtgacaatgcccgtacccctatgcaatgggacgagagcaaaaacgctggtttctcaacaggtcaaccttggttggcagtgaatccaaactatcaagcaatcaacgttcaagaagcgctgacaaatccagattctattttctatacctatcagaaactggttcaaatccgtaaggagaatagctggttgattcgagctgactttgaattgcttgatacggttgataaggtctttgcctatatccgtaaggacggtgaccgtcgcttcctagttttggctaacttgtccaatgaagagcaagacttgaccgtagaaggaaacgtcaaatcggttttgattgaaaacaccgtggctcaggaagtttttgaaaaacaaagcttagctccatgggatgctttctgtgtggaattactataaacattttttacagaaaaatttaaaattgaaatcgtataaaaacaagggaggactgtatgaaagacagaaatcctttgtttttttatgactaaagtttataaactttcattctcaaaattcaattaactttacaaattcccactattttggtaaaataaacttatgttataaaaactaacataaaggagaaagaagatgaatacaaaaaagcgtgttcttagcgcaggcctgacctttgcggctgctttgcttttagctgcttgcggacaatcaggttcagatacaaaaacttactcatcaacctttagtggaaatccaactacatttaactacttgttagactactacgctgataatacagctatcattactaacctagttgatggtttgcttgaaaatgacaaccacggaaacctagttccatctttggcagaggactggtctgtttcaagcgacggtctgacttatacctacaaattaagaaaagatgctaaatggttcacggctgacggtgaagagtacgccccagtcaaggcccaggattttgtgacaggtatcaagtacgcagtggataataaatcccaggccattgacttgattcaaaactcgatcaagggcttgaatgattatattacaggagcggattctgacttttctaaggttggagtgaaagcaattgacgaccagactgttgagtatactttggcgcgcccagaaccttactggaactcaaaaacaaccaatagtatccttttcccagtgaatgaagaatttctaaattcaaaaggcaaagattttggtaccttatctccagatagtattctctacagcggaccttatttgttaaaagatttcacatcaaaatcatcgatcgagtatgtgaagaacccacattactatgatcatgacaaagtatcaattgaacacgtaaaattggcttactttgatggttcagaccaagaattgaccatccgtaactttgaaagtggagcttattctatcgctggggtttatccaaatagttctaactttgctaagaccaaggagaaatataaggataatatcgtctatagcttgcaggacaagacttcttggtatttcaatttcaacgtcaaccgtaaggcttacaaccatacgtctaaaacgacagatgagcagaagaagtcaactgagacagctgtcttgaacaaaaacttccgccaagcggtgaactttgccctggaccgcacagcctattctgctcagtcaaacggggaagaagcagctagcaagactcttcgtaacaccctagtgcctcctacatttgtccaagttggagacaagacctttggagaagtagttgcttctaaattggtcaactatggcacagaatggtcagatattaacttggcagatgctcaggatgcctatttcaacaaagaaaaagcccaagcaaaatttgcggaagctaaaaaagaattggcaagtcaaggtgtgactttcccaattcacttggatgttgcagttgatcagactagtaaaaatgctgtgacaggcatgaactcagttaagcaaacccttgagtcggttttaggtgctgataacattgtcattgatgttcaacaactttcaacggatgattttaataatgtagcctttttagcgccaacaccagctgatcgtgactatgatttgaactttgatggttgggtaggtgactaccaagatccgtcaacttatcttaatcctttcaatgcagaggatggattctacctcaagatttttggtctagatgctcaagaagataaagctaagattgctagcttgggacttgatacttacaccaagatgctcaaagatgcagatagcgaaaataaagatgtagccaaacgctatgaaaaatatgctgaagcacaggcttggatgattgacaattctctgattatgtcagcaatgtcaagtggtggtacagcatctgtaaccaaagtaacgccatttacaagaggctattcactggtcggcatcaagggtgatggcaataactacaagtacatgaaactgcaaaaagatactgtgacaaccaaacagtatgaagaagctaagactaaatgggagcaagaaagtaaaaaagcaatcgaaaaagctcaaaaagaagcagaaaatcatgttaaataaagatgaatgaggttccgtaagggacctttttgatgtttatatagtaaatttattgatgtaattgtttgcaaatcaaaaagaatgtttcggaaagaagatgaaaacgccttacctaagcggatttatctcacaagtgtatttttttatgatataataaaatgaaataaaaattgataatagaggtatatcgtgagtagatcttcgaagcgagctcgtcagggtaaaacaaaaatattgattagttgggggttgctagctatctatgcattactagcagtctttttattgtttttgattttcaagtacaatatgctagccttccgatatctcaatatagtggtcactgtcttaattgtagccttagctatcttgtgcttctttttaattcggtccaagaaagttcaaaatctaacgctgattttattactacttggtgtgttaatcactggtacttctctctttgccgtagggcagttcattggatttaccagtcgtttgaatgcaacatcgaattactcaaattattcgatgagtattgcagtgttagcagatagtccaattgataatatcagtcaggtaagcagtgtgatgggaccgactgggacggataaggataatatccaacagttgatgaatgatcttaaggatagtcaaaatagggaattgactgtcgaagaaagtagctcctatcttgcggcctataagagtttgctagctggtgatacaaaggcaatcattctaaacagtgtctttgaaaatattatcgaatcagaatatcctgactatgcttcaaaaattaagaaaatctataccaaagaattaaccaagacggttgaaactccaaaagatatcaaaggtaacagtttcaacgtttatatcagtggaattgatacttacggtccaatcagttcagtttctcgttcggacgtcaatatcattatgacagtgaatcgcgaaactaaaaagattctcttgacaacaacacctcgtgattcctatgttccaattgcagatggaggcaacaatcaaaaagataagttgacccatgcggggatttatggagtagatgcttcaatacatacactggaaaatctctacggtattgatttgaactattatgctcgtttgaatttcacttctttcttgaaattgattgatctccttggtggagttgatgtttataatgatcaggattttacatcattacatggtaagtttcattttcctatagggaatgtacatcttgattcggagcaagctcttggttttgtgcgtgagcgctattctttggcagatggagatcgggatcgcggccgtaaccagcaaaaggtcattattgcaattctgcaaaaattaacctctacagaagctttgaaaaattatgacagtattataaaagggctgcaagattcgattcaaaccaatatgccacttgaaaccatgatgaacttggtcaatgcccaacttgaaagtggtggaacttataagatcaattcacaagatcttaaagggacagggcggatggatttaccatcctatgccatgcctgatagtaacctctacatgatggagataagtgatagcagtttagagtcagtcaaggctgcaatcaatgatgtgatggaagggaaataagacaaaatgattgatattcattcgcatattgtatttggtgtggatgatggtccgaaatctaagcaagaaagcaaggcgcttttgacagaagcctatcggcaaggggtaaggactattgtatcgacatcgcatagacgaaaaggaatgtttgaaactcctgaggagacgatagaggcaaactttcaagaagtgaaggagctagccaaggaagtggctccagatttgaacattctctatggagcagaaatttattatacccatgatgtgcttgagaagttagaaaaacaggtgattccaagtctcaatgggacacgctatgctctcattgagtttagtatggctaccccttacagggaaatccatactgccttgagcaatgttctcatgcttgggataacgcctgtagttgcccacattgaacgttaccatgaattagaaaataacgaaaaacgtgtaaaagagttgattgacatgggctgctacactcaaatcaatagctcaagtattttaaaaccaaagttatttggggataaatataaatttatgaagaaacgagctcgctatttcctagagcgtgatttggtacattttgtggcgagcgatatgcacaatttagaccaaagaccgccttacatgaaagaagcttatgagatcgtctcaaaacaatacggtgaaagaaaggcgagagaattatttatcgaaaatcctcgctttatcttggcagatcaaattatttaggagttgacatgaaagaaaataaagaaatcggaattgatgttgttcaattatttaaaatcctttggaagaagaaactcgctatcatactaactgcggttgtgacagcgttacttgcatttggcttgagtagttttgtgttgaaaccggaatatgctagtacaacacgaatctatgttgttagtcgcaatcaatctgaaaatacagggttgacgaatcaggatttgcaggcaggtacctatcttgtaaaagactataaggaaattatcctttcgcaagatgtactggaaaaagtcatttcaaatcttaaattagagaaaacagttaaagaactaactaagaaaattcaggtgacagtaccggtagatactcgtatcgtatcgatcgttgttaaggatgatcaaccagaagaagcaagtcgtatcgcaaatgctcttcgtgaagtggcagctgaaaaaatcattaaggtaactcgtgtatctgatgtaacaacattagaggaagctagaccagcaataacaccatcctcacctaatattcgtcgaaatactgcacttgctttcctagtaggtggagcagtgatggttgttgcagtcgtattgcttgaattattggacgatcgtgtcaaacgaccagaagatgtcgaagaagtcatgcaggttgcacttttaggaattgttccagatttggataagttaaagtaagggagaaaacatgccaacattagaaatctcaaaaaagcgtttagattttgctaaaaaagctgaagaacactataatgctttgcgtaccaatattcaattgagtggtgataatttgaaagttcttgctatttcatctgtcaaacctggtgaaggaaaatcgacaacgttaactaatatcgcctgggctttcgcgcgtgcaggctataaaacattgctagttgacgcggatatccgtaattcagttatgtctggtgtcttcaagtcaagggaaaaaattactgggttaactgacttcttagctggaactactgatctttcaaatggtctctgtgataccaatattgataacctatttgttattcaggcaggaccgatatcacctaacccaacggccctcctgcagagtgaaaatttccataccatgattgataccttgcgtaagtattttgactatgtcattgtggatactgcaccgattgggatggttattgacgccgctatcattacacaaaaatgtgacgcttctatcttggttacggcagctggagagacaaaacgacgtgatatcttaaaggcaaaggaacagttagaacaaacaggaactccttttttaggtgtggttctaaataaattcaacaccgaagttgaaaaatatggagcttatggtggttatggagcctatggttcctatggaaattatgggaaaaagaagtaggtagagttacctaggaggtagttttgagagaagtatcaaatattcgaaaactagagattctcataatacaactgtttccaatttatctgttatcgtttgtattagctagtcatgaacttctggtatttctgatggtggttcacactatttcttactacattagtgcatatagtaaaaatttcaaataccggacccttgcagaggaatgtatacaaacgttaaaatatatactggtttatattttcttatcctgtctagtttttcctattttagaaccaaatataccatatttatcattagctaatctattatgcattgtgactgtaaattcaattatgctaatgattgtcaatatttggattcgtaagatttggaaatatctatcacttcaaaaaaaatatactcagcgtatcttgctagtgaccacacgtgcacgagttgagagagtactaaagcaactgtctacttatgagtatggctatgtttcagctgtttgtattgtggatgatgagcattttgagtcttctaatttgacaatcgttacgttggataacttagtaacctatgctacgagatcagtcgtagaccaagtggtgattaatctcccaagcgagagctttttaattgcagattttgtttctaaatttgaaacgatgggtttaccagtagctgtcaatatagcagctttagattttgtgaccaatggtgaaaaagcgattcaacgctttggaaattctagtgttgtcaatttttcaacaaccttttatcgttcgagtgatgttgctttaaaacgaatgatggatataatcggatccttatttggtctagttctttgtggcatagcgtctatttttcttgttcctctgataaaaagagacggagggcctgctatttttgctcaggataggattggtaggaatggacgtatatttaaattctacaaatttcgttctatgagagtggatgctgaggaaattaagaaggacttgatgagtcagaatcagatgcagggtggaatgtttaagattgaaaatgatccacgcgtgacaaagattggacactttattagaaaaacgagtctagatgaattgccacaattttggaatgttctaaaaggggatatgagtttagttggtactagaccaccaaccttggatgagtatatgaagtatacacctgaacaaaaacgtcgtctaagttttaaacctggaatcacaggcctttggcagattagtggtagaagtaatattaaaaactttgatgatgtggtgaagttagatgttacttatttagatggctggacaatttggaaagatattgaaattttattgaagactataaaagttgtagtaatgaaagatggagcaaagtaatttttgttttatcataaaatgaagtaggagtgatatgagaaaatcagtttatatcattggttcaaaagggattcctgccaaatatggaggttttgaaacttttgttgaaaaattaacagaatctcaaaaagatagcaacataaaatattatgttgcttgtatgcgtgaaaattcagctaaatctggtattacagatgatcggtttgaatataacggagcagtctgttttaatatagatgttccgaatatcggcccggcccgagcgattgcctatgatattgctgcagttaataaggctatagaactagccaaagaaaacagggatgaagctccaattttttacattttagcttgtcgtattggtccttttatttcaaaaattaagaaaaaaattcaggacattggaggcactttacttgtgaatccggatggtcatgaatggctgcgagcaaaatggagcttgccagttcgtaaatattggaaatattctgagaaacttatggttaaacatgccgatttattggtctgtgacagtaaaaatattgaaaaatatatccaagaggattataagcagtatcaaccaaagaccacctatattgcctatgggacagatacagctccttcaagcctgaaagcagaagatgccaaagttcgagactggtatcaggaaaaaggagtttgcgaaaatggctattatttagtggtggggagatttgttcctgaaaacaactacgaagctatgattcgtgaatttatcaaatctaagtctcagaaagactttgtcctcatcacaaatgtggagcagaataaattttacgatcagttgttacaggatacgggttttgacaaagatcctagggtcaaatttgtcggaactgtttatgaccaagagttgctcaagtacattcgtgaaaatgcctttgcttatttccatgggcatgaggttggagggaccaatccttctctactggaagctctagcagccacaaaactaaatttgttgctagatgttggttttaaccgtgaagtcggtgaagatggtgctctttattggaagaaagaccagttggcaagtgtcattgatcaggctgaacgtttagataaacaatctattgaagcctttaataagaaatcaagcaagcgtattgctcaagcctttacatggggtaaaattgtcacagactacgagaaagtatttaaaggatagaaatgcagaaaattttatatcttcacgctggtgccgaaatgtatggtgctgacaaggttttgttggagcttattaaaggtttggataaagaagcctttgaggctcatgtcatcttgcccaacgatggcgtcttagtgggtgcattggaaaaggttggtgctaaggtaaaagtaattgattatccaatcttgcgccgtaagtattttaatcctaagggaatccttgagtattttggctcttataatcgttattcaaagcaaattgctaaatatgctaaggaaaatggcattactctcattcacaacaatacgactgcggtacttgaagggatttatctcaaacgtaagttgaaacttcctttgatttggcatgtgcacgagattatcgtcaaaccaaaagcaatctcagatttcatcaactttttgatgggacgttatgctgatacgatagtgacagtttcaaatgctgtggccaaccacgtgaagcagtctcgttttgtaaaaaatgaccaagttcaggtcatctataatggtgttgacaatggcgcctatcatgaaatggatgccagcgcagttcgtgaccagtttggtatcgcacaggatgccttggttatcggaatggttggtcgagtgaatgcatggaaagggcaaggcgactttttagaagctgtgactccaattttgaaggctaatctaaaagcagtagcttttctggcagggagtgcttttgaaggtgaagagtggcgtgttgatgagttggaaaaggcaatatcagactcaccagtggccggacaaatcaagcgtatcgattattataatcagacaacagagctctataatatgtttgatatctttgtcttgccaagcaccaatccagatcctctaccaactgtagttctcgaatcaatggcttgtggtaaacctgtagtgggttaccgtcatggcggtgtctgtgaaatggtgaaggaaggtaaaaacggctttctcaccacaccaaatcaacctgtagaattgtctaatgctattcaagaattggctaacaataccgagaagagagagcaatttggtgagtcctctgtccaacgtcaaaaagaactcttctcattacagagttatattcagaatttctcagagatatataagaaatacaatactaagatgaatactgaataaattaagaataaaataagaataaaataagaataaattaaaaccaatcgtatatccaattattaattttattcctagacgaagactcaagaataaaaattttacagtcatttgtgataattgttgggctggaaaagtttatcaagaattgggcttgccttatcaaacaccatttgtagggatgtttgtcttttctcctgataacatcaagatgctcgagaatttaaaatactatttgagtggaaatatctccttgaaatttgttaagaaatcaaaatatatcaaggactttgataaagcttatcctttagcgcttcttgatgatattgaacttcatttcttgcattatgtagaccaggaaaaattaactcaaaaatggaaccgtcgtttagaaagaattcattggtataatttgtatttcaagttcaatgataatgatgcttgtaattataaattgataaaggagtttgaaaaacttccttacaagagtaagattatcttctcttcaaagaattacagtgatttaccttctctagttcatttcaaatcagctgaaaagcaaggacacgttggcatcgacttgaaaacgtatcatcgctattttaatgttgtaacttggttgaataaaggaggagaagatttaacatagactatacattaggtaatataattatgaaaccacttttaactgtcgttattccagtttataatgtcgaaaaatatttgaaacgttgtcttgaaagtatactgtctcaagagtggaaatgttatgacattctacttattgatgacggaagcactgacaattctcctcaaatttgtgataattatgttaaggaatatgactttatctcagttatccacaaagaaaatagtgggctttctgaagctcgtaatactggtattttacatgctaaaggggagtatgtttattttcctgattcagatgactggattgaaccacaaacctttgtagaattagcagaagagttggagtctcgagaatttgatatcatttctttcaaccgtgagtttgtaaaaagtgaagaagaaattattttatctgagcccaaaacagatcaagtgtataaaggtaaagaggcttttgtgaaaatgttgacgcatagtcacatcactggttttgccaacgacaaaatatataagaaatctctttttattgagaataatatcctatttcccaaagggaaatattatgaagatttgggaacaaattataagctttttctcttagctaatagagtttatgcgacaaatcaaaaatattaccactacctaattgataaccctgattccattacacaatcatggaatgagaaaaagtttagagatatgtttgaattttataaagaagttttttattcggatttagttcgttcgcaaataaatcaagaagaatttcaaatttcaaaactttattatgtaaatggattaacccatattttagctagtttgtataaatctaaattggataagaaatatttagaactcactaatgaagtgaaacttgaattactaaaaaatagagtctttatttctcaaatgaaagatcaaccaaataagttaaaatatatactgtttagacttaaagtgttaaaatttgcattcagtattcaaaacattttctgatatgatgtaggagtttagtttgaaatactcagttgttattccagtttataatgttgagaaatatatagatcgttgtttacaaagtgttatttttcagaattatgaggacttggagattatagtgatcgagaatggatctacagataatagtcctcatatttgtgatacttatgctaacaagtatcctaatatctcagtctatcacattgaaaaccacggtgttggttttgcccgtaattttggattatcaaaagcaagaggagaattcatatattttgttgatgcggatgattatttaattggtaatctattctctgattttgaagagaagcttcatgataaggttgatttgctggtgtttagttattataattcaatagaaaaagatcttattgaattgaagagaaatcccaaaattttaccgaataatgtcttgttagataaaactaattttataacttcttttaaagaattagttttaacagatatgatgtatacagtatggaataagatttaccgaagagattttctaatagacaataatttgtattttttaaagtatgaactaggtgaggatgtacgatttaacctgagggtatacgattttgttgaaaatattttactgtccacagagtgttactatgtgtacatatcaggtagaatgaattctgcaatggggagttacaattcaaatcgagttacataccagttagaggagttatcacagattgaatacttattaaacaaatggaatatttttgataagtcatttatcgatacattaaaatcaagaattttaatgagtaacatacagaacatagtgctacaaaatatgtctatagagactcagaaaaaaaagattggcaagttatgtagaattgacgatataaattctctaataaatagttctccttctaaattacacattcttatacgtatttttttgaaaagtaaactatatatcattgtaatttttttgaaaagaatacagaattttgtcgataagaaaagatgatacgtatagaaatgtttgttagagtattcaatttattaaaaacatggaaaggtttggaaagtataagtgaatagtactcgctttatatcagagaagatttatctattaactttatttgtatggattatagtttcttcattaattactactacatattttgttagattagatggagcattgttgatttatcgcttatctctatacgctactattgctataattcttataaaagaattatttaatctttcgaatacgatgaattattttagatttcatttaaaacaaatgattctattcatattattcatattatctatgctaatcgtatctaaaaatagagatggtttactggatattacagttattttactggttgcttcagctagagatattgattttaagaagttattaaaaactttctcatatgcatctttttcagtattagcgataacgattttttctagtaattctgggattatttctaatatgtatatgaatgctaatggaggatatcgctatagtttaggttttaattatgtatcttttgcttctcagcgtacgttttttgcaatatgtagttatctgatgtataaaggaagaaaaatatcatatcttgagctattttcttttttgatactcactatttatatgttccaacagacagggacaaccagtcctttttatttgagtcttctcataatactttatacctgttttagtaataagatttttaagaaagattttatcattgataatggctggttgactaagatagtaaatcattgtttttcttttgcgttaacgataatactatatttttgcttctattcatcaggtatgttgtaccatttgaccgacaaattcacccataatcgtcttagattaagtgtagaaggatttcataattttggggtttcaatttttgggagaccgataacatttacaacatttgatatttttgggaacttttctagtaattataattttattgatagttcatttgtccagctccttgttattgatggtttattagttactctatttatgttaccagctttgacaggagtagtatcctatttcaaattaaaaagaagagatactgtactagcttgtataggaattatgacaatacatggtatgtttgatcctcagatgttagtacttcgttactcacctcttattctattgattagtcgactatttatcatgaacgatgagagaaatattgagtaaataaaaacggaatatagaagggttgagaaaatctagtcaattatgaaagttttaaaaaattatgcttataatctttcttatcagttattactcataatactacctatcatcacaactccatacgttacgagagtattttcttcaaatgatttaggaacctatagtttttttaactccatagttacttattttcttttgttagctactttaggagtagccaattatggtacaaaggagatttctggtgatcgaaaaatcattcgtaagaatttttggggaatttatactttacagctaggagcagctatttgttcttttgtactgtatgttttgttatgtctgattttacctgctatgaaaaatcctgtggcctatattctaggttttagtttgctttctaaagctctagatatttcttggttatttcaaggtttagaggattttcgaaagattacagtaagaaatattacggtgaaattagccggtgttatttctatctttctattcataagatcagcaaacgacctatatttatatgttttttttctgacaacttttgaattgttgggacaattaagtatgtggataccagcaagagagtttattggtaaaccatactttgatttgatgtatgctaaaaggcacttgaagccagtcatcttattgttcttacctcagattgctatatcgctttatgtaacattagatagcactatgcttggagctcttgcttcaacaagagatgtaggtatttatgaccaagctttgaaacttattaatattttattaactctagtaacttcattgggtagtgttatgttaccgcgagtttcaaatctattatcatcaggagatcataaagcagttaacaagatgcatgagatgtcatttctgatttataatttggtaattttccctattatagcagggatgttaatcgtaaatgatgattttgtaaattttttcctggggcaagatttccaagaagcacgttatgcgatagcaattatgatttttagaatgttctttattggttggaccaatattatgggtattcaaatcttaatacctcataataagaataaagagtttatgctgtcaacaacaattcctgcaattgttagtgtgggattaaatcttctcttgcttcccaagttgggctatataggtgctgcaattgtgtctgtcttaacagaggtactagtatggctgatacagttattctatactcgttcttatttgagagaggtgcctattctaggtgcattgattaaaattataatctcatctggagttatgtatggtattttgttatttataaaacaattcctcaatgtatcaccaatgattaatgtgggactatatgctgttctaggggcaataatttatgccagcttgatcttaatcttaaaggtcataaatccaaatgagttaaaacaacaattactaaaaaaataaaggggtgtattatgtacgactacttaatcgttggtgctggtttgtctggagcaattttttcttatgaagcaaccaagcgtggaaaaaaagtaaaagttattgataaacgtgaccacattggtgggaatatctactgtgagaatgtagaaggggttaatgttcataaatatggtgcacatatcttccatacttctaataagaaagtctgggattatgttaatcaatttgctgaatttaacaactatatcaactcgcctgtagctaattataagggtagcctttataatctacctttcaatatgaatactttctatgctatgtgggggacaaaaactcctcaagaagtgaaaaataagattgctgagcaaacggctcatatgaaggacgttgaacctaaaaacttggaagagcaagctattaagttgatcggtctagatatttatgaaaaattgattaaaggatatactgaaaagcaatggggacgttctgcgactgaccttccaccgtttatcattaaacgtttaccagttcgtttaacctttgataataattattttaacgaccgttatcaagggattccaattggagggtacaacgttattatcgaaaatatgctgaaggatgtggaagtagaacttggagttgacttttttgccaatcgtcaagaattagaagcttctgctgaaaaagttgtctttacagggatgattgaccaatactttgattataaacatggtgagttagaataccgtagtcttcgttttgagcatgaagttctagatgaagaaaactatcaaggaaacgcagttgtaaactatacagaacgagaaattccttatactcgtattattgagcataaacattttgagtacggcacacaagataaaacggtcattactcgtgagtacccagcagattggaaacgaggagatgaaccttattatccaatcaatgatgagagaaacaatgctatgtttgctaagtatcaagaagaagcaacacagaatgataaggtgattttctgcggacgtttagcagactacaaatactacgacatgcatgtggtcattgaacgtgccctacatgttgtagaggaagagtttaacaaagataatgaaggataaaattgatattgttgttttatgggtagatgggaatgatcctaactttattaaggaaaaacaaagagtaactagtcaaaaggaatcgttaaatgcagacgctgatggtgaacagcgttatcgagaatatggaatttttcagtattggtttcgtatgattgagagacatgcaccgtgggtcaataatatttatttaattacgaatggtcaaaagccgagctggctgaaccttagtcatccaaagttgagatttatatcacataaggaatttattccagaatcctatcttccaacttttaattcagcgactattgagttaaatcttcatagaattgaaggcttgtctgaaaattttatttattttaacgatgacatgtatttgataaaagatgtaaagccttcagatttctttaaaaataataaaccgaggcttttagcagtttacgatgctttagttccatggtcctcgtatacaaacacttatcataataacgttgaattgatttatcgtcatttccccaaaaagcaagccttaaagtcttcgccttggaaattttttaattatagatatggtgctttaatattgaagaatatcttattacttccatggggccctacggggtatgtaaatcaacatcttccagttccaatgaaaaagagtactttagctcatctttggaaaatcgagtcggaggtattggatagaacgtcacggaatcaattcagaaattatggggtggatgtgaatcagtatatttgtcagcactggcaaattgaaagtaatgagttttatccaatttcaaaaaatatgggtgaatcaattgagctaaatcaaattgataagctgaagaagatttttggaaataagaagcgaaaactactatgtgtgaatgatagtattaatattgatgaaagaaatattatacttttcaaaaaattattagaagaacgctatccagaaaagtcatcttttgaaaaatgaaaggtaaaatatgaaatactacttaaaagaagaatttttaaatgatgttaaccaaaaaaatgctggcaataaggcacgtaatgatgttgaaactgtgttaaatgagttgggatatatccctttaagagtattggttgatgattggtataaaatgaatgtactcaaggcacagatacataaatttcaagcactatcaaaagcattcaaacttttaaaaagaggcgatgagattgttatccaatttccattattacaccattccttactatttagtaatttactaaaatcccttagaaaaaaaggtattaaaatctatttcctgattcatgatttagaaacattacgttttgtaaatgatgaaacattaccttttagaatgaaattacgtatgaaaattacggagggatcttctttacattatgtaaatggtattattgctcataataaagtaatgaaaggagtattagtcaataaaggagttcttggagaaaaaattactaatttagaaatctttgattatttaattccagattttatagaaaaaactagtttaagaaaagaacaaccaataattgttgcaggaaatttatcacaagataaagcagcatatctatactcattacctatagaaccacaatttaatttatatggtgttggatttgatgagtctaggaagttatctaatgaaacctactttggttcatttcttccagatgaacttccatcagtattggaaggaagttttggtttagtttgggatggtgacagttctgagacttgtagtggattttttggagagtatctacgctataacaattctcataaagcgtcactttatttggcttctggtttccctatcattgtttggaaggaatctgctttgtctcattttgtcttaaagaataattgtggtatcacagttgattctttgtttgacatacaagaaacaatcaataatatttcggaagaagaatatcaagagttagtagaaaatgcacaaaaggtaggaaataatataagatcaggatattatttgaaaatagctttagagaaactaactaaatacttagtttaaattcactaagtaatgtatcatttgtctctgattactaattagaaaaattctaatttaatatagaaaggtagttcgattatgaaaggtattatccttgcaggaggttcaggaactcgcttgtatcctttgactcgtgctatatccaaacaactgatgccggtttatgataaacccatgatttattatcctctatcgacactcatgttagctggtatcaaagatattttaattatctctactcctcatgatttacctcgttttaaagagctgcttcaagatggttcggagttgggaattaatctttcttatgcggaacaacctagtccagatggtttggcccaggccttcattatcggtgaaaaatttattggaaatgacagtgtcgccctaattttaggagataatatttactatggtcctggtctatctaaaatgcttcagaaggctgctaataaggagaaaggtgcaactgtttttggatatcaagttaaggatcctgaaagatttggtgttgtggaatttgatgaagagatgaatgctgtttctattgaggaaaaaccagaacatcctcgttccaattatgcagtgaccggcctttatttctatgataatgatgttgtagaaatttcaaaaaatattaaaccaagccctcgtggtgaattggaaattacagacgtaaacaaagcatatctagaacgtggagacttatcagttgagctaatggggcgtggttttgcgtggttagatactggaactcatgaaagtttattagaggcgtcacagtacattgagacagtgcaacggatgcaaaatgttcaagtggcaaacttagaagagattgcttatcgtatgggttatatcagccgtgaggatgtattaaagttggcgcaacctcttaagaaaaatgaatacggacaatatttgctccgtttgattggagaagcatagatgacagataattttttcggtaagacgcttgcggttcgtaaggtcgaagctattccaggtatgctggagttcgatattcccgttcatggagataatcgtggttggttcaaagaaaatttccaaaaggaaaaaatgctcccccttggtttcccagagtatttctttacagaaggaaaattacaaaacaatgtatccttctcacgtaaaaatgttctccgtggtctacacgcagaaccttgggataagtacatctctgtagcagatggtgggaaggttctgggttcttgggttgatctacgcgagggcgaaactttcggaaatacttatcaaacagtaattgatgcaagtaagggaatctttgttccccgtggtgtggctaatggatttcaggttctatcagatacagtctcttatagctatctggtcaacgattattgggcattagatttgaaacctaaatatgcctttgtcaattatgcagatccagaattaggaattgagtgggccaatcttgctgaagcagaggtttcagaagcagataaaaatcatccactacttaaggatgtaaaacctttgaaaaaagaagatttgtaaaaaaggaaagactatgactgaatacaaaaaaattatcgtgacaggtggagcaggttttatcggttctaactttgttcattatgtttacaagaactttccagatgttcacgtgacagtattagacaagttgacttatgctggaaatcgcgctaatattgaggaaattttgggagatcgtgttgagttagttgttggtgatattgctgatgcggagttggtagacaagttggctgctcaagcagacgctatcgttcattatgcagcggaaagtcacaatgataattcactgaatgacccatcaccgtttatacatactaacttcatcggaacctatactcttttggaagcagctcgcaaatatgatattcgcttccaccatgtatcgacagatgaagtttatggtgatcttcctcttcgtgaggatttgccaggaaatggtgaaggtccaggtgagaaatttactgctgataccaaatacaatcctagctctccatactcatcaaccaaggccgcttcagacttgattgtaaaagcctgggtacgatcatttggtgtcaaggcaacgatttctaactgttcaaataactacggtccttatcaacacattgaaaaattcatcccacgtcagattaccaacatcctaagtggaattaagccaaaactttatggtgaaggtaagaatgttcgtgactggattcataccaatgatcattcttcgggagtttggacaatcttgacaaaaggtcaaatcggtgaaacttacttaatcggggctgatggtgagaagaacaacaaggaagttttggaacttatccttaaggaaatgggccaagatgcagatgcctatgatcatgtaactgaccgtgcaggacatgacctccgctatgcaattgacgctagtaagctccgtgatgaattaggctggaaaccagaattcactaattttgaatctggtctcaaggaaacaatcaagtggtatacagataaccaagaatggtggaaagcagagaaagaagctgttgaagccaattatgctaaaactcaggagattatcaaattataaaaagcaggaaatagttgctttttattgctatagtgggaagagttacagattaggaaggtgtagagatgattttaattacaggagcaaaaggccaattaggaactgaacttcgttatttattagatgagcgtaatgaagaatacgtagcagtagatgtggctgagatggatattacaaatgaagaaatggttgagaaagttttcgaagaagttaaaccgactttagtataccactgtgctgcctacaccgctgttgatgcagcagaggatgaagggaaagaattagactttgctatcaatgttacggggacagaaaatgtcgcaaaagcatctgaaaagcatggtgcaaccctagtttatatttccaccgactatgtctttgacggtaagaaaccagttggagaagagtgggaagttgatgatcgaccagatccacagacagaatatggacgtacaaagcgcatgggagaagagttagttgagaagtatgtgtctaatttctatattatccgtactgcctgggtatttggaaattacggtaaaaactttgtttttacgatgcaaaaccttgcgaaaactcataagacattaacggttgtaaatgaccagcatggtcgcccaacttggactcgtaccttggctgaatttatgacttatctagctgaaaattgcaaggaatttggttactatcatttatcgaatgacgcaacagaagacacaacttggtatgattttgcagttgaaattttgaaagatacagatgtggaaatcaagccagtagattcaagtcaatttccagcaaaagctaaacgtccgttaaactcaacaatgagtctggctaaagctaaagctactggatttgttattccaacttggcaagatgccttgaaagaattttataaacaagaagtaaaaagtgatattaactaatttgaatcctggtcgttaatgaactccccacgaaaataatagatataatattctcatgacaacagctttgcagtgtgtaagaaatgagttagattaaagaattaaaactgtttctcagatgctattttcaaatatgattaataattccttgactacctaatgtagttgaggtatttttgatattattcatatttttgcaaatctattgtttaaaaaataattttctaaaattctgaaaattctgttgacaggactttaaaaagggtctataatggatagaaaaacaaaggagaatactatgaaaacaaggaaagtattggctcttgcgggagtcactttattagcagctggtgtcttagcggcttgttctggtggttctgctactaaaggtgagcagacttttgcatttacctacgagacagacccagataatctcaactatttgacaaccagcaaggcagctacttcaaacattactagtaacgtcattgatggattgtttgaaaatgaccgttatgggaatcttgttccctctatggcagaggactggtcagtttctaaagatggtttgacctacacttataagattcgtcaggatgccaagtggtacacatctgaaggggaagaatatgctcctgtcaaggctcaagactttgtaacaggtcttaaatatgcaacagataagaaatcacaagctctttacttggtacaggattcaatcaaggggctggatgcttatgctaagggagaaaataaagatttttctcaagttggaattaaagcccttgacgatcaaacagtccaatacactttgaacaaacctgaaagtttttggaattctaaaacaacaatgggtgtcttggcaccagttaatgaagagtttttgaactcaaaaggggatgattttgctaaagcgacagatccaagcagtatcttgtataatggtccttatttgttaaaatctcttgtggctaaatcttccgttgaatttgcaaaaaaccctaactactgggataaagataatgttcatgttgataagataaaattgtcattctgggatggtcaagataccagcaaacctgcggaaaactttaaagatggtagtcttacagcagccagactttatcctacaaatgcaagttttgcagaacttgaaaaaacgatgaaggacaatattgtctatacccaacaagactctacgacttatctagttggtacaaatattgaccgccagtcctataaatatacttctaagactagtgacgaacaaaagacttctactaaaaaggctctcttaaacaaggatttccgccaagctattgcttttggtttggatcgtactgcctatgcttcacaagtgaacggtgccagtggtgcaagcaaaattttgcgtaatctctttgtgccaccaacatttgttcaagctgatgggaaaaactttggcgatatggtcaaagaaaaattggtgacttacggggatgaatggaaggatgttaatctggccgatgcccaagatggattatataatcctgaaaaagccaaggcagaatttgccaaagctaagtccgctctacaagctgagggagtacaattcccaattcacctagatatgccagttgaccagacagcaactacaaaagttcaacgtgtacagtctttcaaacaatcggttgaagaaaccttgggtacagataatgtcgtaattgatattcaacaactacaaaaagatgaagtcttgaatattacctactttgctgaaacagcagctggggaagattgggatatttcagataatgttggttggtctccagactttgcggatccatctacttacctcgatattatcaaaccatcagttggtgaaaacactaaaacctactttggctttgattctggtacagataatgctgcagctaagaaggttggtctgaacgactatgagaaattggtaactgaagctggaaatgagacaatagatgtagcaaaacgttatgataagtatgctgcagcccaagcttggttgacagatagtgccttgattattccaacaacatcactcactggtcgcccaatcttgtctaagatggtaccatttacgatgccgtttgccttctctggtaacaaggggacaagcgatccgctcctatacaaatacttggaacttcaagacaaggcagtcacagcagatgaatatcaaaaagctcaagataaatggatgaaagaaaaagaagaattcaataaaaaagcgcaagaagaacttgcaaaacatgtgaaataagataaaaagaagttagttgttagctaacttcttttggttttgagaaaatagattgatgcctatcctcatgttttagatgtcaatgagtctattgaattgtagaaaaaatcctgagttttgcttctcaggattttctttcatctcactgttgtggttgttgaacttgtggattttgtggtgctggttgtactggctgcgttggctgaacagcttgaccagcttgtccttgattaggatcagttgctggagcattatttggttgttgaccaaccgttgtacttgcctgtgtagttgaactttcagcggttgtgcttggagtttctactgtttgtgtttgttgtgtagctggattattccaggcgttcttcgcgttgttttggaagacgaattctccatttcgatacaagccatctggcattgtccagtctccaggatggtcatcttcagaaaggtaagttatcattgaacggtagaccttaccagccacaaggaaaccatctccgatgattggagttagacgatttgagtatcctgtccaaacagccattgcatatttacgagtataccctacaaacatttcatctggggctacgtagccagtgttcttgatatacttttcaatttcgtcgtcagtatagttagaagtacctgtcttacctgcttgtggaagccatggtaggtaggctccacgtccggtaccgtatactaggactgttttcatcatttcagtcatcatataggcagtagtttctttcatagctcgtgtgccggcatcagaaaattctttctcactaccgtcgctaaagacgattttattgatgtacattggcttgtggtaaataccaccattagcaaaagcagcgtaggcagcagccattttttcactacttgcaccgtattttttgttggattcagttgtattacttgaaatggcgtttgcataatgcatgcttggataatcaataccaagcccattaaggaaggctttagccttatctagaccgaccttattcaaagtttcaacggctgtgacattacgtgattgttgaagagcatattggacagtaatgtttccaaagtagccatgatcccagttgtagactggagtatcagtaccaggatagttataaggaacatcatgaacaatatatgcagtagagtcatagactccatattctaaagcgggagcatagtcagtgattggtttcatagtagaaccccagtcacggttggtttcaacggcttggttaacaccgaaagatacattacttgattggtgacgggcacctagttgagcaatgactttaccatttgttacatctacgatggttgaagctacttggagttcatcatctggataggcaacatattcatctgtgttgtaaacatcccaaagtcgctgttgaacatctttgtccacatttgtgtagacatccatacctgtagtcagaaggttgtaaccagtttcttgttcaacttggtcaatgacttctttgaggtagttatccatataggctgggtaactattggctgattttaagctctgaagaccgtcagtgataggcgtattgattgctttctcatactgttctgcactgatgtaattttgtcccttcatttctgaaagtaccaagttacgacgctcgagagcagcttctggatgggaatatggatcatattggtttggtgcctgaggcattccagctaggagcgctaactgtggcaagcttaaatccttcaagtctttttcatagtaattttgggctgcggtttgcattccatagttaccgttagacatgtagactttgttgatgtagtaggttaggatttcttgcttagttgctttttgttctagttgaacggccagccaagcttcttgggctttacgtgacaaggtttgatcagcagttgaagttgagaaataagttaatttaatcaattgctgggtcaaggttgatgccccttggagtcctccttttccttggaggtttcgcaatgctgcacccatgatacgaatggtatcgacacctctatgatcaaagaaacggtggtcttcgatagacacaattgccttgactaagtcagtaggaatttcatttgcttgagcatttacgcgacgttcagatccaaggtcagcaatcagttcgttcttattgtcataaatcttgctagaagttgtcgcgattagtttactttcagataaggctggagccttgctaacaaagtagaggaagacaccaccacctaatagaaataaagcgataaataaggtaaggaatgtaattcccatatactttaaaaatcgcagaataatttgtttattcatcttgttttaccacctagtaaatgttctttgataatatcgagatagggtatttgagggaaggctccttgctttactaaatatccgtattcttgaatatatccaagtggcattgatttctgccccttatcttgatgataaaagcgaattaaatcaagtgccggcaacaaataagtttcttgttgagaagaaaaatgaagcagtacgaagcaaatgccctgctgttctagaacttgttccatatgttgaatctggtgaagatggaagttcttcattgggatagcatttttttgccgcgtttctttagcttcaaagtcaatgtaatatcctctatacaccccagaataatctgttgtggaagcttgtctaaaataggcttctacaattttggctcgactacgttgaggatagtctactcgaacaatttgaacaggcgtcggctttttatggataactgccatgccatgcgtcagatagtagtcgttggtagcgttgatcatcttttcaaaagtcattcctcgatttgcgaaattttttggttgagaaatggatgtttggcttttttttgatgaaattttatgaggatagttgaccatatttctccttattggtacaataacatcactctattataccataaaaatataaagaaaggtgtaaaaatgaccacagctttaattatgggctattctaattttgacttgggtgtctttaatgaaaaagatatcaggttaaaaattataaagaaagccattcgccgtgatttagaaagtttagcagaagaagggattaaatggctggtatttacagggaacttgggattcgaatcctgggttctggatgtcgcaaatgaaatgaaagaagaatatgatttcagcctagcgacgatttttgattttgaaacgcacggggacaattggaatgcagcgaatcagcttaaacttagccaatttaagcaagtagattttgttaaatatgcctatcccaaatatgaacatacagggcaactgcgtgattaccaacgatttttattggaaaatactgatttagcttattttttctatgacccagaaaatgagaccaaattaaaatttatggataacttgatgaaaaatcaggaaggttatcgcataaaaaggctaacgtttgaagacttaaatgagctagcagaaaatttttctgaaaagtaagcctttgaccttgatttttgtttgcctttttttatataataatactattagaaaccgagaatggagagagagatggcaagtattattttttcagcaaaagatatttttgagcaagagtttggacgtgaagtccgtggatatagtaaggttgaagttgatgaatttttggacgatgtcatcaaggactacgaaacttatgctgccttagtcaagtctctccgtcaagaaattgcagagttgaaggaagaattgtctcgcaaccctgaatctgcaccggttcaagcagaaccacttgaaatgacagcaacaacttctatgacgaattttgacattttgaaacgtctaaatcgtcttgagaaagaagtgtttggcaaacaaattttagataactctgatttgtaagagattatttgaaaagtgcaatttttggataatcgcgtgaggagaatttcttttcatgaggaaagtccatgctagcacaggctgtgatgcctgtagtgtttgtgctaggcgaaaccataagcctagggacgagagatcgttacggcagttgaaatggctaagtcttcggataggtcagagtaggcttgaaagtgccacagtgacggagtctttctggaaacggagagagtggaacgcggtaaacccctcaagctagcaacccaaatttcggtcggggcatggagtgcacggaaacgaacgtagtactctgactgctatcagctataggctgttagtggtagacagatgattatcaaaggaagtggtcctagtcacttctggaacaaaacatggcttatagaaaattgcatataggttggggctgagaaattttctcaacctcattttttaaagtggacatatagaaaggtcttataagactgaaaatgaaaaaagaatttaatttaatcgcgactgctgcagcgggtcttgaggctgtcgttggtcgtgaagtacgagagttgggctacgattgtcaggttgaaaatggccgtgttcgttttcaaggagacgcgagagccatcatcgaaaccaacctctggcttcgtgcagcagaccgtattaagattatcgttggatctttccctgctaagacttttgaggagctgtttcagggagtttttgctctagattgggaaaattatttaccgcttggggctcgttttccgatttcaaaagccaaatgtgttaaatctaaacttcacaatgagccaagtgttcaggctatttctaagaaagctgttgttaagaagttgcagaaacactatgcccgtccagaaggggttcctctgatggaaactggtcctgagtttaagattgaggtctctattctgaaagacatagcaactgtcatgattgatacgacagggtctagcctctttaaacgtggttatcgtaccgaaaaagggggagctcctatcaaggaaaacatggcggcagccattttgcaactctctaactggtatccagataagcccttgattgatccgacctgtggttcaggaactttctgtatcgaggcagttatgattgctaggaagatggctcctggtcttcgtcgctcctttgcctttgaggaatgggattggattagtgatcgcttgatccaagaagttcgcacagaagcagctaagaaagtggatcgtgagttggaactggatatcatgggatgtgacatcgatgcacgtatggtggaaattgctaaggccaatgctcaatcagcaggtgttgcaggagatgttacatttaagcagatgcgcgtgcaggatttgcgttctgataaaataaatggagtgattatctctaacccaccttatggtgaacgcttgtcagatgatgcaggagttaccaagctttatgctgaaatgggtcaagtatttgcaccgctgaaaacgtggagcaagtttatcttaaccagtgatgaagcctttgagaccaagtacggtagtcaggcggataagaaacgtaagttgtataatggaactttaaaagttgatttgtatcaatattttggtcagcgtgtgaaacgacaagaagtaaagtagaaaggaaaaactcatgagtaagaaaagacggaatcgtcataaaacagaacataaagaagcgcaatttgattttgatgatgctaaagagctaacggttggagaagccatgcgaaaaaatgaagaggtggaagcaggtgtgttgcctggagattctatcttggacaagtatgtgaaacaacataaagatgaaattgaggcagataagtttgaaacacgtcagtttagcaaggatgatttagttgaaaaagaagaggtagaggagactcagactctggataatttgcttcaagagcttcgtgaggaaacaggagtaacttctccagctccagaagatgaattgaatcagtttgatgatttagaattaacacgagtttcagaagctcctcttgtcgaagaatttgagaaggaagaggtaccattagttggaacggaagaggctctcacacgttctcgagtcacagatagtgaagatggaaaaagtaagaagaaatgggtgctttacggtattctagcagccttagtggttcttatccttggaactggttattatgtttatcgtcaagtggctcgttcaaccaaggaaatccaaacttctcaatcaactacaaacacgcagccagatgtggaagaattcaataatttatatgatgccttctatacagatagcaacaaaacggctttaaaaaatagccagtttgataaactgagtcaactgaaaaccttgcttgataagttagaaggtagtcgtgaatatacgcttgcaaaatctaagtatgatagcctagcaactcaaatcaaggccattcaagatgtcaatgctcaatttgagaagccagctattgtggatggtgtcttggatactaacgctaaagctaaatcggatgctaaatttacagatattaaaactggaaatacggagcttgataaagttctagataaggctatcagtcttggtaagagccagcaaacaagtgcttcaagctcaagttcaagtgaaactagcagctcaagctctagtcaagcaagcgaaaatactgctagtgagacaagcccaagtagttcaaatactgcctcaactgaaacgagaagtacccgcagtgaagtcaatatgggtgtatcaagtgcaggagttgctgttcaaagaagtgcgagtcgtgtttcttataaccagtctgctattgatgatagcaataattctgcctgggatttcgcggatggtgtcttagaacaaattctagcgacttcacgttcacgtggttatatcactggtaaccaatatatccttgagcgtgttaatatcgttaatggcaatggttattacaacctctacaaaccagatggaacctatctctttacccttaactgtaagacaggatactttgttggaaatggttctggacatgcggatgacttggactactaagcagtcgttacaaaattctttcttttcaaaagtaaaaatgataaaataaaacaaattaaacaagaggagtgtcaaatgacaaaagctaactttggtgttgttggtatggccgtaatgggtcgtaaccttgcccttaatattgaatctcgtggttacacagttgctatttacaaccgtagtaaagaaaaaactgaagatgtaattgcttgccatcctgaaaagaactttgtaccaagctatgacgttgaaagttttgtaaactcaatcgaaaaacctcgtcgtatcatgctcatggttcaagctggacctggtacagatgctacaattcaagcccttcttccacaccttgacaaaggtgatatcttgatcgacggaggaaacactttctacaaagataccatccgtcgtaatgaagaattggcaaactcaggtatcaactttatcggtactggagtttctggtggtgaaaaaggtgctcttgaaggtccttctatcatgcctggtggacaaaaagaagcatacgaattggttgcggatgttcttgaagaaatctcagctaaagcaccagaagatggcaaaccatgtgtgacttacatcggtcctgatggagctggtcactatgtgaagatggtccacaacggtatcgagtatggtgacatgcaattgatcgcagaaagctatgacttgatgcaacacttgctaggcctttctgcagaagatatggctgaaatctttactgagtggaacaagggtgaattggacagctacttaatcgaaatcacagctgatatcttgagccgtaaagacgatgaaggtcaagctggaccaatcgtagactacatccttgatgctgcaggtaacaagggaactggtaaatggactagccaatcatcacttgaccttggtgtgccattgtcactcatcactgagtcagtatttgcacgttacatttcaacttacaaagaagaacgtgtgcatgcaagcaaggttcttccaaaaccagctgccttcaactttgaaggagacaaggctgagttgattgaaaagatccgtcaagccctttacttctcaaaaatcatttcatacgcacaaggttttgcgcaattgcgtgtagcttctaaagaaaacaactggaacttgccatttgcagatatcgcatctatctggcgtgatggctgtatcatccgttctcgtttcttgcaaaagattacagatgcttacaaccgtgatgcagaccttgctaaccttcttttagatgaatacttcttggatgtcactgctaagtaccaacaagcagtgcgtgatatcgtagctcttgctgttcaagctggtgtaccagtaccaaccttctcagcagctattacttactttgatagctaccgttcagctgaccttccagctaacttgatccaagcgcaacgtgactactttggtgcccacacttaccaacgtaaagacaaagaaggaacattccactactcttggtatgatgaaaaataagtaggtctgccatggggaaacggattttattacttgagaaagaacgaaatctagctcattttttaagtttggaactccaaaaagagcaataccgagttgatcaggttgaggaggggcaaaaagccctcttcatggctcttcagacagactatgacttgattttattgaatgctcgtctgggggatatgacagcccaggattttgcagataagctgagtcgtactaagccagcctcagtcatcatggtcttggaccatcgtgaagaattgcaagatcagattgaggcaatccaacgctttgccgtttcttacatctataagccggttattattgacaatttggtggcccgtatttcagcgattttccgaggtcgggactttatcgaccaacactgtagtcagatgaaggttccaacgtcttatcgcaatctgcgtatggatgtagaacatcataccgtttatcgtggcgaagagatgattgctctgacccgtcgtgagtatgacctcttggctactcttatgggaagcaagaaagttctgactcgtgagcagttattggaaagtgtctggaagtatgaaagtgcgaccgaaacaaatatcgtggatgtctatatccgttatctacgtagcaagcttgatgtaaaaggtcaaaaaagctacattaaaaccgtgcgtggtgtcggttacaccatgcaagaatagaaaagcagttgcagttatgtaactgctttttttgaggggtgttctatatattgacatgcgattttgtatttgctacaatcagctatggaggataggtctaatgaaaataataaaaaaaattgatgcaaatcgcattagtattctttttctttggtttactggcaacaaaggcagtattggcggatgatgctgattcagaaggttggcaatttgtccaagaaaatggtagaacttactacaagaagggtgacatcaaagaaaaggcttggcgagtgattgatggcaagtactattattttgatcatgtatcaggagagatggttgttggctggcaatatatcccgtttccgtctaaaggtagtacaattggtccttacccaaatggtttaagattagaatttatgccaatgccaagatggtattactttaatcaagatggggtcctacaagaatttgttggcaagcaagttttagaggcaaaaactgctacaaataccaacaaacatcatggggaacaatatgatagtccagcagagaaacgagtctattattttgaagatcaacgtagttatcacaccttaaaaactggttggatttatgatgagggacactggtattatttacaaaaggatagtggctttgatgctcgtatcgacagtttgacggttggggagctagtgcgtggttggaccaatgataactcaacttggtactatctagatccaacaactgctacaatgcaaactggttgggaacaacttggcaataagtggtactacctccgctcatcaggagcaatggcaactggctggtatcaggaaggctcaacttggtactatttagatgctgaaaatggcgatatgaaaacaggctggcaatacctcggtaacaagtggtactatctccgttcatcaggagctatggcaactggttggttccaggtcaatggcaaatggcactatgcttatagctcaggtgctttggcagtgaatacgaccgtagatggctactacgtcaactacaatggcgaatgggttcaataatgaaagaggcgattgtgaaggaaacaatcgctttttttgtgaaaatataatagaatagataggagagaataaatacttgtaggaaaaaataatactcttcgaaaatcaaattcaaaccacgtcagcgtcgccttaccgtagctatggttactgacttcgtcagttctatccacaacctcaaaacagtgttttgagcaacctgcgggtagcttcatagtttgctttttgattttcattgagtatgagacggctttttcgtctagtaaaaggaaaatatgacaaaaaaagttggtgtcggtcaggcacatagtaagataattttaattggggagcatgcagtcgtttacggttatccggctatttccctgcctcttttggaggtggaggtgacttgtaaggtagttcctgcagcgagtccttggcgtctctatgaagaggataccttgtccatggcagtttatgcttctctggagtatttgaatatcaaagaagcctgcattcgttgtgagattgactcggctatccctgagaagcggggaatgggttcgtcagcggctatcagcatagcggccattcgtgcggtttttgactactatcaggcagaactgcctcatgatgtattagaaatcttggtcaatcgggctgagatgattgctcatatgaatcctagtggtttggatgctaagacctgtctcagtgaccagcctattcgatttattaagaatgtaggatttacagagcttgagatggatttatctgcctatttggtgattgctgatacgggtgtttatggccatactcgtgaagctattcaagtggttcaaaacaagggcaaggatgccctaccgtttttgcatgccttgggagaattgacccagcaggcagaagttgcgatttcacaaaaagatgctgaaggactgggacaaatccttagtcaagcgcatttacatctaaaagaaattggtgttagtagccctgaggcggattctctagttgaaacggctcttagccatggtgctctgggtgccaagatgagcggtggtgggctaggaggctgtatcatagccttggcaaccaatttgactcaagctcaagaactagcagaaagattagaagagaaaggagctgttcagacatggatagagagcctgtaacagtacgttcttacgcaaatattgctattatcaaatattggggaaagaaaaaagaaaaagagatggtgcctgctactagcagcatctctctgactttggaaaacatgtacacagagacggccctgttgcctctaccgacggatgcgactgctgatgtcttttacatcaatggtctgctacagagtgaggcggagcatgtcaagatgagcaagattattgaccgttaccgtccagctggtgagggctttgttcgaattgatactcaaaataatatgcctacggcagcgggcttgtcatcaagttctagtggtttgtctgccttggtcaaggcttgtaatgcttatttcaagcttggattgactcggagccagttggcacaggaggctaagtttgcctcaggctcttcctctcggagtttttatggaccactaggtgcttgggataaggatagcggagaaatttaccctgtagagacagacttgaaactagctatgattatgttggtactagaggacaagaaaaaaccaatctctagtcgtgatgggatgaaactttgtgtggagacatcgacgacctttgatgactgggtgtgtcagtctgagaaggattatcaggatatgctgctttatctcaaagagaatgactttgccaaggttggggaattaacggagaaaaatgccctggctatgcacgctacgaccaaaacagcatcaccagccttttcttatctgaccgatgcaagctatgaagccatggactttgtccgtcagcttcgcgagcaaggagaatcctgctactttaccatggatgcaggtcccaatgtcaaggtcctatgtcaagagaaagacttggagcatttatcagaaatcttcggtcagcgttaccgcttgattgtgtcaaaaacaaaggatttgagccaagatgattgctgttaaaacttgcggaaaactctattgggcaggtgaatatgctattctagaaccagggcagttggccttgataaaggctattcccatctatatgaggggagagattgctttttctactcactaccgtatctactcagatatgtttgatttcgcagtagatttgacaccaaatcctgactatagcttgattcaagaaacgattgctttagtggaagatttcctcgtttattgtgggcagactttgcaacctttttctttggaaatccgaggaaaaatggaaagagaagggaaaaagtttggtctaggttctagcggtagcgttgttgttttggtcatcaaggctctgttggctctgtataatctttcggttgatcaggatctcttgttcaagctggccagtgctgtcttgctcaagcgcggagacaatggttctatgggggacattgcctgtattgtggcagaggatttggttctctaccagtcatttgatcgccagcaggtagcaacttggttggaagaagaaaagttggcgacagttttggaacgtgattggggattttcaatttcacaagtgcaaccagccctagaatgtgatttcttagtgggatggaccaaggaagtggctgtatctagtgatatggttcaacaaatcaagcaaaatatcaatcagaattttttaagttcctcaaaagaaacggtggtttctttggtagaagccttggagcaggggaaagttgaaaaaattatcgagcaagtagaagtggccagtcaacttttagaaggcttgagcgtagatatttacacgccttcgcttagacagttgaaagaagccagtcaagatttgcaggctgttgccaagagtagtggcgctggtggtggtgattgtggtattgccttgagttttgatgagcaatcaactgaaaccctaaaaaatcgttgggccgatctggggattgagctcttataccaagaaaggataggacatgacgacaaatcgtaaggatgagcacatccgctatgcccttgagcagaaaagttcctataatagctttgatgaggtggagttgattcattcttccttgcctctttacgatctagatgaaatcgatctgtcgacagaatttgctggtcgaaagtgggactttcctttttatatcaatgctatgacgggtggaagcgataagggaagagaaatcaatcaaaaactagctcaggtggcggaagcctgtgaaattttgtttgtgacgggctcttatagcgcagccctcaaagatccagcagatgactctttttctgtcaagtatgatcatccaaatctccttcttggaaccaatattggattggataagccggttgaacttggtttgcagactgtgacggagatgaatcccttacttttacaagtgcacgtcaatgtcatgcaggaattactcatgcccgagggagaaaggaagtttagaagctggcaatcgcatctagcagactacagcaaacaaatccctgttcctattgtcctcaaggaagtgggctttggaatggatgccaagaccatcgagagagcctatgaattgggcgttcgaacctttgacctgtcaggtcgtggtggtaccagttttgcctatattgaaaatcgccgcagtgggcaacgtgattacctcaatcaatgggggcaatctaccatgcaggcccttatcaatgcccaagactggaaagacaaggctgaactcttagttagtggaggtgttcgcaatccgctggatatgattaagtgtttggtctttggtgctaaggctgtaggactctctcgaacagttctagaattggttgaaacctacacagttgaagaagtgattggcattgtccaaggctggaaagacgatctgcgtttgatcatgtgtgcccttaattgtgccaccatagcagatttgcaaaaagtagactatcttctttatggaaaattaaaagaagcaaagaatcagatgaaaaaggcgtaaccaccgcctttttttccatcctcagactgaggtgacttttttgaagtgtgataaaatagaagggagaggatgaacctatgagaaaatttaaaatctttttatttatcgaagcctgtcttttgacaggagctctgattttgatggtttcagagcatttttcgcgttttctgctgattttattcctctttttgcttttgattcgctattacactggtaaagagggcaataatcttcttttagtggtggcaaccattctcttctttttcatcgtcatgctcaatccttttgtgattttagctatttttgttgcggttatatacagcctctttcttctttatccgatgatgaaccaggaaaaagagcagaccaatttggtgtttgaagaggtggtaacggttaagaaggagaaaaatcgttggtttggcaatctccatcatttttcaagctaccagacttgccagtttgatgatatcaatctctttcgtctcatgggcaaggacaccattcatctggagagggtcattctaaccaatcatgacaatgtcattatccttagaaagatggtaggcacgaccaaaatcatcgtacctgtagatgtggaagtcagtctcagcgttaactgtctctatggggatttgacttttttcaaccagcccaagcgagccctccgtaatgaacactatcatcaagaaacaagagactatctcaagagtaacaagagtgtcaagattttcttgaccactatgattggcgatgttgaggtggttagaggatgaaaaaacaagcttatgtaatgattgctctcacctccatcttgtttgtcttgtttttctcccacagcttgctggaaatccttgactttgactggtctattttcttgcatgatgtcgaaaaaacagaaaaatttgtctttttgttgttggtattcagcatgtccatgacctttctcttagccctgttttggcgaggtgttgaagagctttctctaagaaaaatgcaggctaatctcaagcgtttgttggcagggcaagaagtagttcaggttgcagatccagatttggatgccagtttcaagtccttgtctggcaaacttaaccttttgacagaagcacttcaaaaggctgaaaatcacagccttgctcaggaagaggaaatcattgagaaggaaagaaagcggattgctcgggatttgcacgatacagtcagtcaggagttgtttgcggcccacatgattttatcgggtatcagtcagcaggctttgaaattggatagagaaaagatgcagatccagttgcagagtgtcacagctattttagaaacagcccagaaggacttgagagtcttgctcctgcacttgcgaccagttgaactggagcagaagagcttgatagaagggattcaaattctcctaaaagagcttgaagacaagagtgatcttaaagttgctttcaagcaaaatgtgacgaaattgcctaagaaaatcgaggagcatatcttccgcatcttgcaagaattgatcagcaataccctccgccatgcccaggcatcttgtctggatgtctatctctatcagacagattttgaattgcaactgaaggtggtggataatgggattggtttccagttagggagtttagatgacttgagttatggactacgcaatatcaaggagcgggttgaagatatggcagggacggttcagttattaacagctcccaagcaagggctggcagttgatatccgtattcccctgctcgataaggaatgataaaggagtaaagatgaaaattttactagtagatgaccatgaaatggtccgattgggcttgaaaagctactttgacctccaagacgatgtagaagttgtgggtgaggctaccaacggatctcaaggcattgacttagccttggaattgcgtccagatgtcattgtcatggatatcgttatgcctgagatgaatgggattgacgcgaccttggctatcctcaaagaatggcctgaagccaagattttgattgtgagctcttacttagacaatgaaaaaatcatgcctgtcttaaatgctggtgctaggggatatatgctcaagacttctagtgcagacgaactactccatgctgttcgtaaggtggctgctggcgagttggccattgagcaagaggtcagcaaaaaagtcgaataccaccgcaatcacatagaactacatgaggacctgactgcgcgtgagcgagatgttctccaacttatcgccaagggctacgaaaatcagcgtatagcagacgaactttttatctctctcaagacggtcaagacccatgtgtctaatatcctagccaaacttgaagtcagcgatcgtacccaggctgcagtctatgcctttcagcaccacttggtgaggcatgaggagttttagatgagtctagcagatttgcttgtggagctagaagccgcaaaagattctcaaaaagcaggggccatggaagcctatatgcgccatcaattttcctttctaggcattgcggcgcctgaaagaaataaactctataaaaaatactttccaaaagcgaaaaaaacaagggccatcgattgggattttttagatacttgctgggaaaaagagtatagagaataccagtatgtagctgctaattatttgaaagcaatgcagtcttatctaaaggacagcgatttgcctaagctagagcagttggttgttaccaagtcttggtgggatacggtggatatcctagatcgagtagtagggagtttggtgtatgacaagcaggaactggaaaaaataattctccaatggagcctgtcagacaatatctggttgagacgcgtcgctattgaccaccagttgttaagaaaagagaagaccaatgttcaattactggaaaagattctgcttcataatttgaatcaaacagaattctttatcaataaagccattggctgggctctgagagactactccaaaacgaatccagcttgggtagcatgcttcattgagaaaaacaaggaaagaatggctgaccttagtatcaaagaagcaagcaagtacctctcccatcattgaaaagcgcattcattacttgaaaaaagtcgtccatttatgttataatagactgtatttaaaaaattttaaggagaaatgacagaatgtctgtatcatttgaaaacaaagaaacaaaccgtggtgtcttgactttcaccatctctcaagaccaaatcaaaccagaattggatcgtgtcttcaactcagtgaagaaatctcttaatgttccaggtttccgtaaaggtcaccttccacgtcctatcttcgacaaaaaatttggtgaagagtcactttaccaagacgttatgaacgctcttttgccaaacgcttatgaagcagctgtaaaagaagctggtcttgaagtcgttgcacaaccaaaaattgacgtaacttcaatggaaaaaggtcaagactgggttatcactgctgaagtcgttacaaaacctgaagtaaaattgggtgactacaaaaaccttgaagtatcagtagatgtagaaaaagaagtaactgacgctgacgttgaagagcgtatcgaacgcgaacgcaacaacttggctgaattggttatcaaggaagctgctgctgaaaatggcgacactgttgtcatcgacttcgttggttctatcgatggtgttgaatttgatggcggaaaaggtgaaaacttctcacttggacttggttcaggtcaattcatccctggtttcgaagaccaattggtaggtcactcagctggcgaaactgttgatgttatcgtaacattcccagaagactatcaagcagaagatcttgcaggtaaagaagctaaattcgtaacaactatccacgaagtaaaagctaaagaagttccagctcttgacgatgaacttgcaaaagacatcgacgaagaagttgaaacacttgctgaattgaaagaaaaataccgtaaggaattggctgctgctaaagaagaagcttacaaagatgcagttgaaggtgcagcaattgataaagctgtagaaaacgctgaaatcgtagaacttccagaagaaatgatccacgaagaagttcaccgctcagtaaacgaattccttggaaacttgcaacgtcaaggtatcaaccctgacatgtacttccaaatcactggaactactcaagaagaccttcacaaacaatacgagggagaagctgagtcacgtactaagactaaccttgttatcgaagcagttgccaaagctgaaggatttgatgcttcagaagaagaaatccaaaaagaagttgagcaattggcagcagactacaacatggaagttgctcaagtacaaagcttgctttcagctgatatgttgaaacacgacatcacaattaaaaaagctgttgaattgattacaagcacagcaacagttaaataatcttatactcttcgaaaatctcttcaaaccacgtcagcgtcgccttaccgtactcaagtacagcttgtggctagcttcctagtttgctctttgattttcattgagtattaataaacaaaaatcccacctgaattggtgggttttcttatgcactattttccaaaaatctctttgaggtctgcgtctgtaatcccaatcatggctggtatactgtcccagttttcttctgtcaggatgtaggattgttcagaggtacttgatgtggcagtttcagagacagctggttgcttttcttcaacattttccaataaatcactgaagcgttcaatcagataggtttttcgggcagttccgatatgttgggtagcataatcaaaggcctgtaattcgcctagtaagataagcttgcttttggcgcgtgtaatggctgtgtagatgagattgcgctccagcatacgcctgctagcactggtgataggtaggataacaacagggaactcacttccctgcgatttatggatactcatggcatatgccaagcgaatcttgtaccattcgttacgtgggtaagagacttcgttgccgtcaaaatcaatgacaatctcatcttgtttcgactcagtatatttgccgggaatcaggtctgtgatagctcccaaatccccattaaagacattgatttcagcatcgttgaccaaatgaatgaccttgtcgcccttacgatagtggcactggggagcttcaaaactgagctgatttttttgtggtggattgagcaggtcttgcatgagctgattgatagcatcaattcctgccgtccctcggtacatgggagccagaacttggatatcacgggcaggaataccacttctgagggcagcacctaagattttttcaatcgtagctggaatatggccactagcaatttcaaagtaggaacggtctgcttttttctgggtgaaatcagctggcaagatgccctgtcgaatttgactagctagggtgacgatggttgattcttcgctttgcctgtaaattttttccaagcgagtctgaggaatcaagggaatatgaagcagatcagctagaacttgtccaggactgacagaaggcaactggtcgctgtcgcccacgatgaggattttactgttagaagagatgttggagaagagttgattggccagccaagtatccaccatggaaaattcatccacgatgataaagtcagcatccagataatcttccagatgactggtatcatcgtcacctgtcattcctaaatgtcggtgtatggtcgcgctaggcaaacctgtcaattcattcatgcggcgagctgctcgtccagttggagcagcaagaagaatcggcaggttgctttttttcctgaggtcaagtccttctaaaagggcataaacagcgatgattccattgataacagtcgtcttacccgtaccgggcccacctgtcaggataaagaccttgttctggatagcgtcgcagatagcctgtttttgaatgatatcatacttaatccccagatcttcttcgacagtagtgatatgtttttgaatggtttttaaatcctggctcttctgttttcctttttcaaggatacggaccaagtgactgcggatgccttcctcagcgaaaaagaggctgttgtcaaaaattttggtatcaatctgctgaatcttgtcttcttcaatcaggtaggagagctcttgggccacttggctgggatccagttccacgggacgagaagactcaaggagagtaagggtttgttccagcaaatcccgtgcttcaacataggtgtcccctgtttccatacaggtctgaaaaagactgtgaactagaccggcacgaaagcgttcaggagcctgactttcgatgcctagttcttctgctaattggtcagcaatagtaaagcccaaacccttgatatcttcaactagttggtagggataattttcaaccacgtcaagggttttttccttgtaaaagtcttgaatctgaaaggctaatttattgggaatgccgtagttggctagtttggccaagaccatctcggttccgtagttgagacgaagagttgagacgaaggcctcgcgatttttggcagagagtcctgcaatgccttctaacttttctgggtgttgcaaaatttcgtcaatggtattgccgccataggtatctacaattttttgagctgttttgagaccaattcccttgaaatggctacttgaaaagtacttgaccaagcccttgctagttggttttgcgcgttcataacgactgatttgcagttgctccccatacttggagtgctggacaatttgtccccaaaaagtatagtcttctccctcaatcacatcagccatggtgcccgtgacaatgatttcaaaatcatcaaaatcctctgcgtctgtatcgtcgatttctaggagaaggatgcgataaaaattgctgggattttcaaaaataatccgttcaatagttcctgaaaaataaacttccataagattcctttgcataaataggtgagagttaatactcttcgaaaatcaaattcaaaccacgtcagtttcgccttgccgtactcaagtacagcctgcggctagcttcctagtttgctctttgattttcattgagtataactttgtttctatcctagttagactgggtagagaataatcatcttcttacgatagaagaagaggctgagattcttgattctcggcctcttaggtctcttaaaatgttccgatacgggtgattggccagaagcggaatttagcttcccctgtgatatcttttgctttgaaggtacctacgtggcggctgtcgctagaaaccaggcggtcgtctccgaggagaaggtattctccttctgggacagtaaagctaaagttggtgttatagttgacatcaactgtgaaggcttgggctttttgagcgatacttctaaagaaagttcctttatttccttcaaagcccttgcctgagtaggtgctttggagtttgtcatccttgaaacgtttgatgtagtcagctaagtaaggctcatccgtctctttatcattgatgtaaagtttatcattttcataacggacggtatcgccaggcattccgatgacacgcttgacgatgtctttattgccatcttcctcatgggccaccacgatatcaaaacggtcaataggaaggtgcttaacaacaaagaggatttcgccatccgctagagtcggatccatggaatgtccttctacgcggacattactccaaaaaaagatacggctcaaagctagtaatgacagaatcaggaggaacaatccccactcttttagaaatgttttaaaagaatacataacttacctttctaagcgttttttcgctttttcagtatttttaaagtgcagtttggcgcagaagttaagtccctgcataccataggcttgcaaaatctggctagccaccttgtcagatgccgttccagctccacttggaagttgatagcccagttctcgtcccagattttctagattttccagaaagagatcacgcgcaatgatagaagaaactgcgacagccaagtatttgccctcagccttttcttctaggctgataggattgctgaaacgattggcctcttgtgccaagtacttgtcataatttttagcactggtaaaggcatcaatcacaattttctcaggctgaagaccttttttaaggaggagatagatagcctgattatggagggcaaccttaaccgaaacagcgttgtagcggtctccgatgacctcgttgtacttgcttggtgagagcagcagtgcctggtgctggattttttctttgaggataggggcaatctgacggatttttaggtcggtcagagttttagaatcccccacaccaagttttcgcaagaaggcatgctggtcaggtgtgacaaaggaagccacaactgcaagcccaccaaagtaggaaccatttcccacctcatctgtcccaattaaagggaaattttgtcccctgttttcctctacaacttgatatccaaagaaacgagcgtatttctcagctccttcaccctgaagcaagacctttccagaagtatagatagaagccgttgcttgaggtagtcgcaaaaagtagcgaatatagggattcttgctgggagctagactggtttgatagtgttcaagaaaagcctgaatctccttttcacttggtgtgagtgttatacttgccatagtttctattgtatcataaaagcaggcaaatttgtaaaaactgacaaaattagcgaattttggtataatatcgtgaggtgaattttatggcaaatctaaatcggttcaaatttacattcggaaaaaaatcactaaccttgacaagcgagcatgataatctctttatggaggaaatcgctaaggttgcgacagaaaaataccaagcaattaaagaacaaatgcctagtgcagatgatgaaacaatcgctcttttgttggcagtcaactgtttgtcaactcaactcagccgtgagattgaatttgatgataaggagcaagaattagaagaactccgtcacaagctcgtgacttgcaagcaagaacagagcaagattgaggattccttatgatttcattctttcttctattggtcttggcttggggattttatatcggctatcggagaggcctgctcttacaggtttattacctgatttcagccatggcatcggcttttgtggctggccagttttataagggacttggagagcaatttcatttgctgctcccttatgcaaatccgcaggaaggtcagggaactttctttttcccatcggatcaactctttcagttggataaggtcttttacgcagggatcggctacttgcttgtatttgggattgtctatagcatcggtcgtttgcttggtctccttttgcacttacttcctagtaaaaaactgggtggtaagttgttccaagtttcagcagggatcttgtccatgttggtgaccttatttgtcttgcaaatggccttgaccatcttggcgaccatccccatggcagttatacaaaatcctcttgaaaagagtatcgtcgcaaaacacatcatccagagcataccggtaacaaccagttggctcaaacaaatctgggtgacaaatttaatcggataaaaagggcaggagttttcctagccctttgtttacagattgactagaatctatcagaatgtaaaaagctaccacacctagacattcaaagacaaggaaataaagatgaataagaaaatattagaaacattagagttcaataaggtcaaggccttgtttgagcctcatttgttgaccgagcagggcttggagcaattgagacagctggctccgactgctaaagcggataaaattaaacaggcgtttgctgagatgaaggaaatgcaggctctttttgttgagcaaccgcattttaccattcttgcaaccaaggaaatcgcaggagtctgcaagcggttggagatgggagcggacctcaatatcgaggagttcctacttttgaagcgcgtgcttctttctagcagagaactacaaagtttttatgataatctggaaaatgtcagcttggaagaattagccctttggtttgaaaaattacacgattttccgcaattacaaggaaatctccaagcctttaatgatgcaggtttcattgaaaattttgccagtgaagaattggcgcgaatccgtcgaaaaatccatgatagcgagagtcaggtccgtgatgttttgcaggacctgctcaagcaaaaagcgcagatgttgacggaaggtattgttgccagcagaaatggccgtcaggttttaccagttaaaaacacctaccgcaataagattgcaggtgtcgttcatgatatttctgccagcggaaacaccgtctatatcgaaccccgtgaggtggtcaaactgagcgaagagattgctagtttgcgagcagatgagcgctatgaaatgcttcgcattctccaagaaatttctgaacgtgtccgccctcatgcggctgagattgccaatgatgcttggattatcggccatctggacttgattcgtgccaaggttcgttttatccaagaaaggcaagcagtcgttcctcagctgtcagaaaatcaggagattcaactgctccatgtctgccaccctttggtcaaaaatgccgtcgcaaatgatgtccattttggtcaagatttaacagccattgtcattacaggtcccaatacaggtgggaagaccatcatgcttaaaactctgggcttgacacaggttatggcccagtcaggtttgccgattttggcagataagggaagccgtgttggtatttttgaagaaatctttgccgatattggagatgagcaatctattgaacagagcttgtctaccttctctagccacatgaccaatattgtggatattcttggcaaggttaaccaacattcacttttactcttggatgagttgggagctggtacagaccctcaagaaggagctgctcttgccatggctattctggaagaccttcgcctgcgtcaagtcaagacaatggcgaccacccactatccagaactcaaggcctatggtatcgagacagcctttgtgcaaaatgccagcatggagtttgatactgcgactctacgcccgacctatcgctttatgcagggtgtgcctggtcgaagcaatgcttttgaaattgctaaacgtttaggattatctgaagttatcgtaggagatgccagtcagcaggtcaatcaggacaatgatgtcaaccgaatcattgaacaactggaagagcagacgctagaaagtcgcaaacgcttggacaatatccgtgaggtggagcaagaaaatcttaagatgaaccgtgctctcaaaaagctctacaatgagctcaatcgtgaaaaggaaaccgagcttaacaaggcgcgtgaacaggctgctgagattgtggacatggccctcagtgagagtgaccagattctcaaaaatctccacagtaaatctcaactcaagccccacgaaatcattgaagccaaagccaagttgaaaaaattggctcctgaaaaagtagatttgtctaaaaacaaggttcttcaaaaggccaagaaaaaacgagctccaaaggtgggagatgatatcgtggttctcagttacggtcagcgtggtaccttgatcagtcaactcaaggacggtcgctgggaagcccaagttggcttgattaagatgactttagaagagaaagaatttgaccttgttcaagcccagcaagaaaagcaagtcaagaagaaacaggtcaatgttgtgaaacgaacttctggtcgtggaccacaagccagactggaccttcgaggcaaacgttatgaagaggccatgaatgagctagatgcctttatcgaccaagccttgcttaataatatggctcaagttgatatcatccatggtatcggaacaggtgtcatccgtgaaggtgtcactaaatacctacaaagaaacaaacatgtcaagagtttcggctatgccccgcaaaatgctggaggcagtggtgcgaccattgtgacgtttaaaggatagaagtattccgagctttatacagtaaaaactgttgaattaagttttactaataaacacattgacaaaagccaacattttttgtaaaataagaatcaattaaataccaacaccgaatgaagtttaatagaagtggggaatcgtttgattttccatgactgtaaatggacggaactctggagagaccgtaaaggcaccgaaggggcaaggcaggcaactgctcaaactctcaggtaaaaggacagagctaggatagaccgctttttagcatttatctaagcattccagagtacatgtatcttgcatgtgctctttcttttggggttgaaaagataggagaaggaaatgttagaattgcttaaatcaattgatgcttttgcttggggtccacccctcttgattctattggtcgggacagggatttacctaactgctcgtctaggcctcttgcaggttttgcgtttgcctaaggcctttcagcttatttttactaaggacaaggggcatggcgatgtatccagctttgcggccttgtgtacagccctagcagcgacagttggtacgggaaatattatcggggtggcgacggctatcaaggtcggtggcccaggagccctcttttggatgtggatggccgctttctttggaatggctaccaagtatgcggaaggactactagctatcaaataccgtaccaaggatgaccatggtgcagtagcgggaggtccgatgcactatatccttctagggatgggagaaaagtggcgtccccttgctatcttctttgccctggcaggtgtcttagtggctttattggggatcgggaccttcacccaggtcaactcgattacagaatctatccagaatacaacaactatttcgccagcaatcacagctcttgtgttgtctgtatttgtagcgattgcagtctttggtggactcaagtccatttcaaaggtttcaactaccgttgttccttttatggccatcatctatattttgggaactcttacagttattttctttaatattgggaaaatccctgctacaatcgctttaatcttgacatcagcatttagtcctgttgctgcggtaggtggatttgcaggtgctagcattcgaatggctattcaaaatggtgtagcgcgtggtgtgttttcaaacgaatctggtctgggttctgctcccattgcagctgctgccgctaagacaaatgaaccggtagagcagggcttgatttccatgacaggaacctttattgacaccctcatcatctgtactctgactggtttgaccatcttggtaactggtgtttggagtggtgacttgaatggggtggctttgactcagtcagccttctcaacagtcttttcacactttggacctgcccttttgaccatcttccttgtgctctttgcctttacaacgattctaggttggaactattacggggaacgttgttttgagtttctctttggggttcgctttatctggctctaccgtgtggtttttgtactcatggtcttgctgggaggattcatcgagttggatatggtttggattatcgcagatattgtcaatgctttgatggctctaccaaacttgattgccctcttagttttatctccagttgttattgctgaaactaaaaagtattttaataaataatggaatcacacatctcgtgtgattttttgctttcataaaaaatttctatcagtgcaatttaaaatatatattatacacggtatagaatctgtgatagactagatttcaacaaaataaaaagaggttttatgatgacaacatttacaatccatacagtcgaatcagcaccagcagaagtgaaagaagttcttgaaacagtagaaaaagataacaatggctatattcctaacctaattggtctcttggctaatgcaccgactgctttagaggcttaccgtactgtcggagctatcaaccgtcgcaacagcttgacacccgttgagcgtgaagtggtgcaaatcacagcagccgtaaccaatggttgtgccttctgcgtcgcaggtcacacagccttttcaatcaaacaaatccagatgaatgatgaccttttgcaagccctccgcaatcgtactccaattgaaacagatcctaaattggacaccctagctaagtttaccttggcggttatcaataccaagggtcgtgtaggagatgaagccttatctgaatttttagaagctggctacacccaacaaaatgccttggatgtggttcttggtgtcagcctagcaagcctttgtaactatgccaacaacctagctaataccccaattaatccagaattgcaaccttatgcttaattcatatctgagtaaaatgaagtctgaaataatcggacttcgtttttttatcccctcatttaagcacttttatgctatactgaaactgacatgattattggaggttaagatgaaaaaactccccttggtattttctggttgtttgctaggtttggcaggagctggaaatcttatgttagatacgttaccgattctgtcccatctgcttagtctgacaggtttgattttgtggatttactttctgattttgcatttgtttagttggaaggaaaccaagcaagaattgactaagcctcctcttttgtcaggaatggggacctttcccatggctgggatgattttatcgacttatgtctttcgcattttccctcatttgccaatagtagcgcaaggactctggtggttttcttttctcttggattgggccttgattgttatttttacaattaaatttgcctatccatgtaagagagtaaactctactcccagctggacggtgctttatgtggggatagcagtggcagccttgacctatcctctcgtaggtatcatcgaaattgcctatgtgaccttgatttttggatttctcttgaccttctatctctacccgcttatttatagcgatttaaagaaacatccactcccgctagccttgcttgcgcaagaaggaatctactgtgctcctttctctctactcttggcttcccttgttcgagttggaggagagagcttaccaaattgggtcttaatcgtcatgattttggcttctcaatccttctttttctttgttttaactcgcctgcccaatattttaaaacaaggctttcaaccatccttctcagcccttcccttcccaaccattagcacagctatcgcgctcaagatgtctcagggaattttgaaacttccatttctggattatctggtagtggctgaaaccgttatttgtctaactattttattctttgtattaggcgcttatctgatttggttacgaaaaaaggtctagctagaaatagctaggccttatttttatggtttgataacttcagctccacccatgtatggacgaagtgcttctgggatggtcacagaaccatcttcattttggtagttttcaagaatagcagccactgtacgtccaactgcaagtccagaaccgtttaaggtgtggagcaattttaccttgccatctgcttcatcacggtaacggatttgggcacgacgggcttggaaatcttctgtgtttgaacagcttgagatttcacggtaggtattttgtgctggaatccaaacttccaagtcgtaagtcttggcagctgagaagcccatatctccagtagagagagcaacgacacggtatggaaggttaagtttttgaaggatgttttcagcattggctgtcattttttccaattcttcgtaagattcttctggtttggcaaatttaaccatttcaaccttgtggaattggtgcaaacgaatcaagccacgagtatcacgaccagcagaaccagcctcagaacggaatgaaggactcatagcagtgaagtagattggcaggtctttaccatcaaggatttcatcacggtagtagtttgttagaggaacttcagctgtaggaatgaggacataattgctgtcgctcaattcaaaagtatcttccttgaattttggatattgaccagtaccaaacatagaatcgtggttaaccatgtaaggtgtgatgacttcagtgtagccttcttttccatgttcatccaacataaagttgtaaatagcacgttccaaacgagcgccgagacctttatagaagaggaagcgagctcctgttaccttaccaccacgttcccagtcaaggatgccaaggtcttcacccagatcccagtgagctttaggttcgaaatcaaactcgcgtggagtaccccaacggcgaacttccacattgtcatcttcgtcaaccccaacaggaacgctatcagctggaatatttggaagagtagtggtaaattctgtcaatttagcatcgatttctgccaattcagcatccaaggctttgacttcagcagatagagtttgcatggcagcaatcttgtcatctgcattttccttgttgcgcttagcttgggcaatctcagcagaaactgtgttacgttctgcttttaaagtttcaaccttgaccaagatgtcacgacgtttagcatcgatttctttcatctcattcaagatagcagcatctacaccacgtgtagctaatttttctgcgacagcatcaaagtctgtacgaatacgtttgatatctaacataagaactcctttatgaaaaaagcacacctgacaaagcgttggagtggcagggccacggttccatccaacttcacaggtgtgcacttgattgtgtatgcaattgttactaacggtagaatttcacctatccctcctatctgctcgcagcacccgcagactttctgaaagaagaagataacctacttatccgttgctatgattatactaaagtttctacttttttgcaaatagatttttaaatttttgactaatggtttgaatcagggtcggaagtttgacgaccttgtcattgcccagtttttcgcgagcaattttaagaatggcacctgagtcttttgaagcaaagaggaattttcctctgtctgtaaagacttcgaagtggcgactgatttttcgcccagtgacatttgccccaatttggttgatatggctccaaggaatctggataaattgttcaacattgacatcggggtaaaattccaaagcctgatctccgacaaggaatttcccaactttcccagctatagagaggtaggaggtgcctgtcgtattgaggagcactgttttgttaagtgattgagccatgcttagtcttccttactttcaccgaaaaaggcattgtagagggctttaatagctgctttctcttggtccttatggacaacaaacatgatagacacttcactagaaccttgagacatcatctggatgttgatcttattttcagatagagcacgtgtcgcagtagcagttactccgatatggctcttcatcttttctccaacaatcataatgattgaaaggtcgtgctcgatttctgcatggtctacttcagccttttgaaccaactgacgaaggatttcttcttccttgataggagttagttcgcgagaacggagaatgattgaaagatcgtcgatacctgttggcatatgttcccaaccgatgttaagatcttcaaggatttgaagaaccttgcgtccaaatccaacctcacggttcatgaggtatttagacatgttgatgctgacaaagccagagtcaccagcaattcctactactggaaattcatcactactgtgttttagaacgatacgagtacctggatgatcaggattgttggtattcttgataaccagaggaatttttccacggtaggcgggaagaagggcttcgtcatgaaggactgagaagcctgcataggccaactcacgcatttcacggtaggtcaactctgggatagagtgtggttggtgaatgattcctgggtgagccgcaaagataccatcaacatccgtaaagttttcatagaggtctgccttaacaccggcagcaatgatagaacctgtaatgtctgatcctccacgtgagaaggtacagatttgattttccttggtaactccaaagaaaccaggaatgacaagaacttcatttgtatttgtcaattcttcaatcttgtcataacttgatggaatgatgcgagcgtgaccaggttcacttgtgaccacaataccagcttctctagggtgcacatagcgtgcatcgatcccgttttgattaaagtaggcagcaatcaatttagcattgttattttcaccagctgctaggaaagtgtcgtagagaaattcgttttcttcgataggaagagtagctaaggcacgaatgcttttagaaattttttctagcacagctggtttaagacctagttcactaaccatagcagcatagcggtcgataatccagttttgactcttactaatatcgttaccagcaacatagtcgcggtagtatttaatcaaggcatccgtaaccttagtatcttcagcattgcgtttaccaggcgcagaaacgactacaaaacgacgctctgaatcgctttttacgatgtttaaaactttttctaattgactagcagaggcaagagagctacctccaaatttaacaaccttcataagaactcctaaagtaagtattttatacgattatagcagaaagaaagccttttttcaatgaagaaaataagatgctttctagtataaagcgatcctttctaatcggctgagacactttcagttgattttttcttgctttctgattttaaaaaagatatactttgaaaatagaataatttaaactgcttataaaataaaaaggagtcctgatggaacacattatttatcagcttgaagaggatttggcaattcttaccttgaatcgtcctgaggtcgcgaatggttttcatattcctatgtgtgaggagattttagaagctctgactttggcagacgaggatccggctgtgcattttgtcttaatcaacgcgaatggcaaagtcttttcagttgggggagatttagtagagatgaagcgggcagtggatgaggatgatattccatcattgacgaaaatcgcagaattggtcaatactatttcttataaaatcaagcaaattgcaaagcctgttttgatggaagttgatggggctgttgcaggtgccgcagcgaatatggctgttgctgcagatttctgtctggcaacggataaggctaaatttatccaagcctttgttggagttggtttggctccagatgcaggaggaattcatcttttgagccgaagtattggtgtgacgcgtgctactcaactagccatgacaggagaggctttgacagcagaaaaagctctagagtggggcctagtttaccgcgtttctgaagctgataaacttgaaaagacgagagaacagcttcttaaaaaattaagacgtggttcaagcaattcctatgctgccattaagaagttggtgtgggagagccaatttaaagattggcaagattatgctactttagaactgaaccttcaggggtcactagcgaaaacagaggatttcaaagagggagttcgggctcattcggaaagaagaagacctaaatttacaggaaaataaaaaaatacttgcaccattctttgaactttgatataattctcttgtcaaatgttttgattctaaaagtttttttgaaaaggagggaaggaaagattggactaccaacgaattaatgaatatttaacgtctatatttaacaatgtcctcgttattgaggaagttagcttgaggggtagtcgtttcaaggatatctccatcaaagaaatgcatacgattgatgtgattggaaaagttccagatgtgacaccaagtcaagtgtcaaaagagttgatggttactcttgggacagttacgactagtttgaataatctcgaacgcaagggttacattgaacgcattcgttcagaacatgatcgacgtgtagtgcatctgcatttgacaaagaaaggtcgcttggttcatagactacataaacgcttccacaaggctatggttgaaaaaatcattgatggtatgagtaagcaagagatggaggttatgagcaaaggtttgaccaatctttatcaatttttggaggatttgagataatggcttttgcaaaaataagccaggttgctcattatgtgccagagcaagtggttacaaatcatgatttggctcagattatggataccaatgatgagtggatttcaagtcggacgggaatacgacaaaggcatatttcaagaacagaatctactagtgatttggctacagaagttgccaagaaactgatggcaaaagctggaatcacaggagaggagttggattttatcatcctagctaccattactccagattcgatgatgccctctacagctgctcgtgttcaagctaatattggtgctaataaggcctttgtttttgacctaacagcagcttgcagtggatttgtatttgctctttcaactgctgaaaagtttatcgcttctggtcgctttcaaaaaggcttggtgattggtagtgaaaccctctctaaagcagtcgattggtcagatcgatcaacagctgttttgtttggagatggtgctggtggtgtcttgttagaagctagcgagcaagagcgtttcttggcagagagtctcaatagtgatgggagtcgtagcgagtgtctaacttatggacattcaggcttgcattctccgttttcagatcaagaaagtgcagattcatttttgaagatggatgggcgcgcagtctttgattttgctattcgggatgtagccaagtctatcaagcagactattgaagaatctcctgtagaggcaacagacttggattatctgctacttcatcaggctaatgaccgtatcttggataaaatggctaaaaaaattggtgttaaccgagataaacttccagccaatatgatggaatatggcaataccagtgcagccagtatcccgattttactttcagagtgtgtagaacaaggcctcatccgtttagatggtagccagactgttctactatcaggcttcggtggaggcttgacatggggcacgctcattcttacaatttaggtaatcatgtggtgaacacattgttataaaaaaactatttattttaaaggagtcctatcatggcagtatttgaaaaagtacaagaaattatcgttgaagaacttgggaaagacgcatcagaagtaacacttgaatcaacttttgatgatttggacgcagattcattggacttgttccaagtaatctcagaaatcgaagatgcttttgatatccaaatcgaagcagaagatgacttgaaaacagttggtgacttggttgcctatgttgaagagcaaacaaaataagcagaatataagatagaaggagtagggaaacccgctccctcttgtttaggcaatagtttgattgtcaaattatgacggtatcgaactattacgtaagcaagaaacgatggaggcactatgaaaacgcgtattacagaattattgaacattgattatcctatttttcaaggaggaatggcctgggttgctgatggtgatttggcaggagctgtttccaaggctggaggactagggattatcggtggggggaatgcccctaaagaagttgtcaaggaaaatattgataaaatcaaatcattgactgataaaccctttggtgtcaacattatgctcttgtctccctttgtggaagatattgtagacctcgttatcgaggaaggggttaaggtagttacaacaggcgcaggaaatccaagcaaatacatggaacgtttccatgaagccggtattacggttattcctgttgtaccaagtgtggccctagctaaacgcatggaaaaaatcggtgcggatgccgttattgcagaaggaatggaagctggggggcatatcggtaaattaacaaccatgaccttggtgcgccaggttgctgctgctgtatctattcctgttattgctgcaggagggattgcggatggtgaaggtgctgctgctggctttatgctaggtgcagaagctgttcaggttggaactcgttttgtcgttgcaaaagagtctaatgcccatccaaattacaaggcgaaaattttaaaagctagagatattgatactacaatttcagctcaacactttggacatgctgttcgagctattaaaaaccaactgactcgtgattttgaaaaagctgagaaagatgcctttaaacaagaaaatccagatttagaaatttttgaacaaatgggagcgggtgctctagccaaagcggttgttcacggagatgtggatggtggatctgttatggcaggtcagatcgcaggacttgtttccaaagaagaaacagctgaagaaatcctaaaagatttgtattacggagcagctaagaaaattcaagaagaagcctctcgttgggcaggagttgtaagaaatgactaaaacggcctttttatttgctggccaaggtgcccagtatctaggtatgggacgggatctctatgatcactaccctattgtcaaagaaacgattgatcaagcaagtcaggtgcttggttacgatttgcgtcatctcattgatagggaagaagaaaaacttaaccagacccgctatacgcaaccagccattttagcgacttcagttgctatctaccgtttattgcaagaaaagggctatcaacctgatatggttgctggtttgtctcttggagaatactctgccttggtggccagtggcgccttggattttgaagatgcggttgccttggttgctaagcgtggagcctatatggaagaagcggctcctgctggctctggtaagatggtagcagttctcaatacgccagtagaggtcattgaagaagcctgtcaaaaagcttccgaacttggagtggttaccccagccaactataatacacctgcacaaatcgtgattggtggggaagtggttgcagttgatcgagctgtagaactcttgcaggaagctggtgccaaacgcttgattcctcttaaggtttcaggaccttttcataccgctctccttgagtcagctagtcagaaactagctgaaactctagctcaggtaagtttttcagattttacttgtcccctagtcggcaatacagaagctgcagttatgcaaaaagaagacattgctcaactcttgacgcgtcaggtcaaggaaccagttcgtttctatgaaagtattgcggttatgcaagaagcaggcgtaaccaactttatcgagattggaccggggaaagtcttgtcaggctttgtcaaaaaaattgataagacagctaaactagccaatgttgaagatcaggcgagtttggaagctcttctaggaaactagtaatcccttctcccataaatacaggaggaaacaggagaaaagaatgcaactaaaaaataaaaatatctttattacaggttcgagtcgggggattggtcttgccattgcccacaagtttgctcaggcaggagccaatattgttttaaacagtcgtggtgcaatttcagaagaattgctcgctgagttttcaaactatggtgtcaaggtggttcctatatcaggagacgtgtcagattttgtagacgctaaacgtatggttgatcaagctattgcagagctgggttcagtagatgttttggttaacaatgcaggaattacccaagataccctgatgctcaagatgacagaagcagattttgaaaaagtgctcaaggttaacttgactggtgcctttaacatgacacaatcagtcttgaaaccgatgataaaagctagagaaggtgctatcattaatatgtctagtgttgttggtttgatgggaaatatcggtcaagctaactatgcagcttctaaggctggtttgattggttttaccaagtctgtggctcgtgaagtggccaatcgcaatatcagggttaatgctattgcacctggaatgattgagtccgatatgacagctgttctatcagacaaggtaaaagatgctatgctggcacaaattcctatgaaagaatttgggcaggcagagcaggttgcagatttaacagtatttttagcaggccaagattatctaactggtcaagtggttgccattgatggtggcttaagtatgtagcagaagctagaggtaaaaaagatgaaactaaatcgcgtagtagtaacaggttatggagtaacatctccaatcggaaatacaccagaagaattttggaatagtttgacaactggaaaaatcggaattggtccaattacaaaatttgatcatagtgactttgatgtgcataatgcagcggaaatacaagattttccttttgataaatactttgttaagaaagataccaatcgtttcgataactattctttgtatgccttgtacgcagctcaagaagccgttaatcatgcaggtcttgatgtagagactcttgacaaggatcgttttggtgttatcgtggcctctggtattggtggaatcaaagaaattgaagatcaagtgcttcgcctaaatgacaaaggaccaaaacgtgtgaaaccattgacccttccaaaagccttaccaaatatggcttcaggaaatgttgctatgcgttttggagcaaacggtgtttgcaaatctatcaatactgcctgcgcttcatcaaatgatgcgattggggatgccttccgctcaattaaatttggtttccaagacgttatgttggtaggtggttcagaagcctctatcacaccttttgctattgctggtttccaagccctaactgctctctcaactacagaggacccaactcgtgcttccattccatttgataaggaccgtaatggttttgtcatgggtgaaggttctgggatgttggttcttgaaagccttgaacacgctgaaaaacgtggggctactatccttgctgaggtggttggttacggaaatacttgtgatgcataccacatgacttcaccacatccagaaggtcagggagctatcaaggccatcaaactagccttggaggaagctgagatttctccagagcaagtagcctatgtcaatgctcacggaacgtcaactcctgctaatgaaaaaggagaaagtggtgcgatcgtggctgttcttggtaaggaagtacctgtatcatcaaccaagtctttcacaggacatttgctgggggctgcaggtgcggtagaagctatcgtaacaatcgaggctatgcgtcataactttgtaccaatgacagctggaacaagtgaagtatcagattatatcgaagccaatgtcgtttatggacaaggcttggagcaagaaattccatacgctatttcaaatacttttggttttggtggccacaatgcagttcttgctttcaaacgttgggagaataaataactatgaatttaaacgatattaaagacttgatggctcaatttgaccagtcaagtttgagagaattttcttataaaaatgggacggatgagttacagtttagcaagaatgaagctagactcgtatccgaagttgcagctcaagtcgctccagcgcccgttctagcaacaccaagtccagcggctcctacatctgctccagcagagcctgtagcagaagaagttcaagctccagctgaaacaagtgtagctgctgagggagatgttgtagagagtccacttgttggggtggcttacttggctgctggtccagataaacctgcctttgtaacagttggtgatagtgttaaaaaaggccaaacattggtaattatcgaagccatgaaagtcatgaatgaaatcccagctcctaaggatggtgtggtaacagaaattctcgtttctaatgaagaaatggttgagtttggtaaaggattggtacgtatcaaatgatcgatattcaaggaatcaaagaagcccttccccaccgttatcctatgctcctagtagaccgtgtgttggaagtgagcgaggataccattgttgccatcaaaaatgtaaccatcaatgagcccttcttcaacggtcattttcctcaataccctgtcatgccaggtgttctgattatggaagccttggcgcaaactgctggtgtcttggagttgtctaagcctgaaaataaaggacaactggtcttttatgctggtatggacaaggttaaattcaagaagcaagttgtaccaggtgaccaattagttatgacggcaacgtttgtaaaacgtcgtggcaccatagctgtggttgaagcaaaggctgaagtggatggcaagcttgcagccagtggtactctaacctttgcaatagggaactaaggaggttctccatgtttcgaaaaattttaattgccaatcgtggtgaaattgcggtccgtattatccgtgcggcgcgtgaattagggattgcgacggtagcggtttattcaactgctgataaggaagcccttcatacgcttttggcagatgaagcggtttgtatcggtcctggtaagcctacagagtcttatctcaatattaatgcggttctatcagctgcagtcttgactgaggctgaggctattcacccaggttttggatttctcagtgaaaattccaaatttgcaaccatgtgtgaagaggtggggattaagtttatcggcccatctggtcatgtcatggatatgatgggagacaaaatcaatgcgcgtgctcagatgatcaaagctggtgttccagtcattccaggttcggatggagaagtgcataactctgaggaagctttgactgtcgctgaaaaaattggctatcctgttatgctcaaggcttcagcaggtggaggtggtaaagggattcgtaaggttgaaaaaccagaagacctcgtttcagcctttgaaacggcctctagcgaagccaaggccaattatggaaatggtgccatgtacatagaacgggtcatctatccagctcgtcatatcgaggttcaaatcttaggagatgaacacggaaatgtgattcacttgggggaacgggattgttctcttcaacggaataaccaaaaggttttggaagaaagtccttcaattgcaatcggaaaaacgctgcgtcatgaaatcggtgcggctgctgttcgagctgcagagtctgttggttatgaaaatgcagggaccattgagtttcttcttgatgaagccagtggtaaattctattttatggagatgaatactcgtgtacaagtagaacatccagtaacagaatttgtttcaggtgtggatatcgttaaggaacagattcgcattgcggcaggtcagcctctgtctgttaagcaagaagatattgtcctacgcggtcatgccatcgagtgtcgtatcaatgcagaaaatccagccttcaactttgctcctagtccaggtaagattaccaatctccatctgccaagtggtggagttggcttgcgcgtggattcagcagtttatccaggctataccattccaccttattatgatagtatgattgctaaaatcatcgttcacggtgaaaatcgttttgatgccttgatgaaaatgcaacgtgccctctatgaattagagattgaaggggtgcagaccaatgcagatttccagcttgaccttatttcagatcgcaatgtcattgctggagattacgatacttccttcttgatggaaacatttttacccaagtatcaagaaaaagaataaaatgacttcaagagtttaaaccgaaaaggggaatcaatggctctatttagtaaaaaagataagtatattcgaatcaatcccaatcgttcggttagggaaaaacctcaagctaagccagaggttccagatgaattattctcccagtgtccaggctgtaagcataccatctatcagaaggatctgggaagtgagcgcatctgtccacattgtagctatacctttcgtatttctgcccaagaacgcttggctttgacgattgatatgggaaccttcaaggaattgtttacagggattgaaagcaaggatcccttgcatttccctggttatcaaaagaaactagcaactatgcgtgaaaaaactggtctggacgaagccgtcgtgacaggaacagctcttattaaaggtcagattgtggctcttgggattatggattccaattttatcatggcttctatgggtacagttgtaggtgaaaaaatcactcgcttatttgagtatgcgactgtcgaacaattgccagttgttctattcacagcctctggtggagcccgtatgcaggaaggaatcatgagtctcatgcagatggccaagatctctgcagcagttaagcaccattcaaatgctggtctcttttatctgaccattttgacagatccaacgacaggtggtgtgacagcttctttcgctatggaaggtgatatcattctggctgaaccacagagtttggtcggttttgctgggcgtcgtgtcattgaaaatacggttcgtgaaagcttgcctgaggatttccaaaaggcagaattcctattggaacatggctttgtggatgctattgtcaaaagaagagacttgccagacaccatttctagcctagtcagattgcatggagggagtcctagatgaatattgcaaaaatagtcagagaagcgcgtgagcagagtcgcttgacaaccttggactttgcgacaggcatttttgatgaatttatccaattacatggtgaccgttcttttcgtgacgatggtgcagttgttggtggtatcggctggcttggggaccaaactgtatcagtggttggtatccaaaaaggcaagagtttacaagataacctcaagcggaattttggtcaaccgcatccagaaggctaccgtaaggccctacgtttgatgaaacaggctgaaaagtttggtcgtccagttgtgacctttatcaatactgcaggtgcctatcctggtgtgggagcggaagaacgtggtcagggagaagctattgctcgcaatctcatggaaatgagtgacctgaaagttccgattatcgccatcattataggtgaaggtggttcaggtggggctctggctctagccgttgcagaccgtgtctggatgttggaaaattccatctatgccattctcagcccagaaggctttgcttctattctatggaaagatggtactcgtgccatggaagcggcagagctgatgaaaatcacctcacatgaattgttagaaatggacgtggtggataaggtgatttctgaagcaggactttctagtaaagaactgattaagagtgtcaaaaaagaactccaaactgagctagccatactttcacaaaaaccgttagaagagttgttggaagagcgctatcaacgatttagaaaatactaatacctcagaatacataaaaactagaactggcagtcagttctagttttttatgtggttcttactctgtatcaaggacgaggtaaaaggtgcttgggaaaccaaacaccttttcgattattcattttcttcagttacaaattgactaagcagtccgttgataaagcgggctgatttttgatctgaaaaattcttagcaagttcaatagcttcattgactgctaccagctgaggtgtatcaaatgatgtgatttcaaagatacccaagcgtagtaagtttttttcgaccaaggtcaatcgttcaactgtccagcctgacttgaggtgctggttgatttgtttatccaactcgtctttttgagcttgaacaccagaaaccaagttcagaagaaaggcagggatttgcacatcttcatcttcacggtcatgtgtatatgcaaagtgacaagctgtttccatatctgtgccgaattcaaggctcatgagggcttgaaaagcgcatttacgaagttcgcgtctagattctaataatggactagtcattgaggaagtcctcgttaaatagatctttcaactcaggttttggtgttttatctggaacgattcctgcaacatggatgttaacagcagcaagttccacatcagccatatctcggacagcatctttgactgctttttgaatagcaagagcaacttttggtactttcacaccgtactcaaggtagaggtagatgtcagcagttagttcttcgttgctttcttttaagtagacgccacgaccaagagagagttttgatagggtatcagatacggatttatttgaaaatgagtggacaccatcaactttagcagttgtgatggcaatgattttttcaagtacacgtggagcgataacgatttcgccaaattgttcttcaattcccatagaatgacctctttctagagattaggcacgagaaacgtaagttccttctgcagtgttgatgatcaatttttgtccagcttcgatgaagtcaggaacgttgacaacaagtccagtttccatagttgctggtttaccagaacctgtaacagtagcacctttgatagatggttgtgtttcagcgactgtcaattcaacagtagttggtacagttacaccgattacttcagttccgtagaattggattttcacatcagagttttcaaggatgtaaagcaattcattttcaacgtttacgactgggatttcgtattggtcgtaagtttcagtgttcatgaagtaggcagtttcatccattttgtacaagtattgagctgggacagtttcgataatagcttgttcgaatttttcttctggacggtagcttgtgtcaaatgtagaaccagtacgaacatcacgcaatttcatacgcatgattgtgtttcctttacctggtttgtggtggctagcttccaaaacgcggatcaattttccgtctgcagtttcaaatgtcataccagctttcaatttgcttgcttcaatcatgtttttacctctttaataaatattattactcttcattttaccataaaatcttctggaaataaagccaaaatagttattgggagatggtaggggagaaaaagaatattgcctagtcaggtggagtggttaatgttaaagagtatctaccatatttcttctcatactcaatggaaatcaaagagcaaactaggaagcaagccgcaggttgctcaaaacactgttttgaggttgtggatagaactgacgaagtcagtaaccatatatacggtaacgtgacgctgacgtggtttgaagagattttcgaagagtattatatttcaaaaggccgaagtaagcttactccgacctgttagtattgtcttaaaaagattgatttttattctggttctaccaaaattttaatttgtgacttatcttgagttaattcgataaagccttcttcgacgatattttccaatttgattttcttagtaaccaatttttcagcagagaagtagccttgttccatcaattctaatactttagggaagatatgacgataagcaatgattccttttagtgtcttttcttggattgcaaattcattcggattaatatttgcttctcgttcccagatagagaccaccatgcactcacctgctttatgtacggcagctaaggcttgtcctaaaactactggcacacccgttacttcataagaaacatctacaccaccgtttgttaaacgatgaatagcttcaacagctgtttcaccttcttccggacggacaacgatagctcctaactcttcagcttttgcttgacgttcaggtgatagttcaacagcataaatcttagaagcacccgctgcacgaagggcttctataattaagagaccaatcggacctaagccaaagacagcagcagtatcaccagcttttagtgctgattgacgaactgcataaactgcaacagcagctggctcagtgagagcagcttgctcatagcttaagctatctggaatgacatgtactaagtcaccgtctaaaacacaatatttggcaaatccaccgtctgcagccaaaccgacaaaattaaggtttggatccaaattataattaccaactaagttattcttagctagaattggttctacagcaacacgatcaccaactttaacacgagtaacatcgcttccgacttctacaatttcaccagaaaattcatgtcccagtgttactggtgctttttgaccagaatagacatgttcttctgttgggatgaagatagggccatctaaaaattcgtggaggtcagtaccacaaattcccgtgaatttaacagcaacttttacttggtgcggaagtacctcagggacttctacttcttgaatacgaacatcttttgctgcatgccagcgagctgctttcattgtagccatatgaataactccttattgttacgatttttagttttctttttaggaaactttacatgtaacattgtaaacgctttccttgtatttgtcaagaaaaaaccaacctcaaggctggtttcttttacatattaatcttctttcaacttcgctaattcctgagcaaggagtttaagggcgacttgtgggttggcttggcctttggttgctttcataaggaatcctgtgaaggccttatctgcgttacgtttacctgacttgaagtcggcaaccgccgcttcgttatcgacaaagacttggtggatgattggaatcaggatttcaggatctgagatttgaaccatacctgctttttcaacgtattcacgcgctcctccgccatttttagctaggtggacaaagactttcttagcaatcttagaagagatagtgccgtcttcgatgatggcaatcatttcaaccaagttttctggtgtcaattcgatttgttctagtgtcttgccttcggcattcaagaactgagcgacttccccttggagccagttagagacttgtttggcatcgccaccgagggtaacagctttttcaaagaagtcagaagtgactttgtttgccgtcaactgactagcatcatagtctgacaagccaaggtcagatacataacgcgcacggcgttcttttggaaactctggcaactcagttcgcatttcctcaatccactcgtctgagatttcaaagattggtaggtctggctctgggaagtagcggtagtctgcagctccttccttgacacgcatgaggatggttgccttgttagcttcatcgtaacggcgtgtttcttgacggatttgaccccctgagcgaaggatttcagcttgacgttggacttcgtattcaagacctttacgaacgtttgagaaggagttgaggttcttcaactctgtcttggtaccgaatttctcttgaccataagggcgaagggagatattggcatccacacgcatagaaccctcttccatcttaacgtcagaaataccagcgtactggataacctccttgagggctgttagataagcataggcttcttcaggagaacgcatgtcagcttcagatacaatctcaatcaatggcaccccttggcggttgaggtcaacataagagtagccatctgtaccgtgggtgtttttaccagcatcttcttctaggtgggcacgttcgataccgattttcttagttgtaccgtcttctagctccacttcaatccagccgttataaccgattggctcatcaaactgagaaatttggtaggcttttggattatcagggtagaagtagttcttgcggtcaaagtgcatctttttgtggatgtccatgttgagggcaagagcagccttgataccggcatcgacaacacctttattaagaactggcagaactcctgggaaagaccaatcaatcacgttagtgttggcattttggtcatttccaaagtgggcagaagtaggtgagaagatttttgaattggtgttgagctctacgtggacttcaagtccaatgactgtttcaaagttcattagttatcacctccaaaaatcacgggttgttgtttgtggtagtctgttgtcgcctcaaaagcagcagcagcttggtaaatggtttcctcagagtacttaggaccgatcaattggagaccgacaggcagaccttgagagaatccagcaggaatagaaattccaggcagtcctgccaagtttacaggtatggtcaagaggtcagccaagtacatagcaactgggtcgtggttgagtgaatccaagtcataggcaacactaggagcagttgggcccaaaatcaagtcgtaatccgcgaagactttttcgaaatcttggatgatgagggtacggacctgaccagccttcttatagtaggcgtcatagtaacctgatgaaagactgaatgtgccaagcatgatacggcgtttaacctcttcaccgaaaccttggctacggctgtttacatagatttcatcaaggttggttgcatcttctgcgcggtagccgtaacggataccgtcaaaacgttgcaagtttgatgaagcttcagatgaagcaatgatgtagtagacggcaacaccgtattttgagtgaggtagactcacttcttcaacaatagcaccaagtttttcaaagtgtttggctgcgttcagaatggttcccttaacctctgggtcaattccttcaccaaggtattccttaggcaaagcaattttcatgcccttgatgtcttggccgatttttgaagtaaaatcggcaatgcggacaggagcagaagtagagtctttggcatcttcgcttgcaatagcattgagcaagaaggcattttccttaacagtcggagcgaaaggtccaatctggtctaatgaactaccaaaggcaatgagaccgaaacgtgaaactgttccgtaggttggtttgagaccgacgatcccattgaaggcagcaggttggcggatagatccaccagtatcagaaccaagtgacaagcgaacttgtcctgaggctacagctgcagcagaaccacttgatgatccaccagggaccttgctgtggtcccaagcattttttagtggcaccgtagtaagaagtctcacctgatccacccatggcaaactcgtccatgttggttttccctacgacaatcatgcctttcgcttttgcattggcaacggctgtcgcatcaaagattggctcgtagttgtagagcatttttgaggctgcagttgtaagaataccgtctgtagagatattatccttaactgcaagtggaattcctgaaaggacattatcagcatcgattccagcttcatcaatagctttagcttgagcaagagcttgctcttcagcgatggtaacaaaagcgttgatagcggtctcgcgagacttgatatcttcaagtgttgcttgtgttaattcagttgctgaaatttccttagagacaaggagattgtgcaagtcttcaatggttttattgttgaaagtcattaggcatctcctccatcgtctaggatagctggtaccttgatatagtagttgtctttttcaggtacgtttttaaacaagcgatcacggtctgttccttcttcggccacatcagggcggagtacagtcttgcggtcagccatggttgtagtaggtgcgacaccagttgtgtcaacttcgcccagcaattcaaccatgtcaacaatcttagacaaggtagtcgcaaaggcagcagtttcttcttcagagaatcttaattttgaaagattggcaacgtgtgttacctcttcttgcgtaattttcatcttgcatcctttcgtgaaatgatgatttttagtctgttctattttaccatattttcctataaataagggaaggaaagatgaaaaaagacaggtataggatggagaacggattctgatgatgatttatttgaaaagcggatttcaaaggggaaaatatatggtacaatagtttaacagagaagtgaagacggtggttacaaaatcgaaaggatggtgatgcttatgtgcagaacctgtaaaatcttagtagaaaggagtaaccagatttgtccccttttgaggctttgacactcatgtttgtagctggtaactttgttatcacgctcctaaggttcatccttgaattggtaaaagagacaaaaaatagccgtcctaactttggcgagttaacgagctattttttagttatgtaattacagccaccgtcttaaacggctctgtggggtgttgttgtcgcaacacctttttctatatttattgtaacatttatttgaaaaattgcaaggggaattgttctactttagcagtgtctgatataaaatagaaattgaaaaaaatgctaaaatccgatataatggagtgttgaaaggaatggtaaaatccaatgtagaaatcattcttagctattgaaacaagaaaaatagagaatcaaagaaagagaacttatgaatattcaagaagaaattaagaaacgtcgtacctttgccatcatctcccacccggacgcggggaaaacaactatcactgagcagttgctctactttgggggcgagattcgtgaggctggtaccgtaaaaggaaagaaaacagggacttttgccaagtctgactggatggatatcgagaagcaacgcgggatttcggtgacttcatctgttatgcagtttgactacgatggtaagcgcgtcaacatcctagacaccccagggcacgaggacttttcagaagatacctatcgtaccttgatggcggtggatgctgctgttatggtcgtggactctgccaagggtatcgaggctcagactaagaaattgtttgaggttgtgaaacaccgtggcattccggtcttcacctttatgaacaagctagaccgtgatggacgtgagccactggacctcttgcaagaattagaagaagtactaggcattgcgagttacccgatgaactggccaatcgggatggggaaagccttcgaggggctctatgacctctataaccaacgcttggagctctataaaggggatgagcgttttgctagtttagaagatggggacaagctttttggcagcaaccctttctacgagcaagtcaaggatgatattgaacttttaaatgaagctgggaatgagttttcagaggaagctattctggctggagaattgacaccagtcttcttcggttcagctttgacaaactttggtgtgcaaacattccttgaaacttttctcaagtttgctccagagccacatggacataagaaaacagacggagaaattgttgatccttacgataaggacttctcaggatttgtctttaaaatccaagccaacatggaccctcgacaccgtgaccgtattgcctttgtacgtatcgtatcgggtgaatttgaacgtggcatgagtgtcaacttgcctcgtactggtaagggtgctaaactgtctaatgttacccagtttatggctgaaagtcgtgagaatgtgaccaatgccgtggcaggagatatcatcggggtttacgatacaggaacttatcaggttggggatacattgacagttggaaaaaacaaatttgaatttgaaccactgccaaccttcactcctgaaatttttatgaaagtttctgctaagaatgtcatgaagcagaaatccttccacaaggggattgagcaactggtgcaagaaggtgctattcagctttataagaattaccaaacaggcgagtacatgctgggagctgttggtcaactccagtttgaagtctttaaacaccgcatggaaggcgagtacaatgcggaagtagtcatgagcccaatgggtaaaaagaccgttcgttggatcaagcctgaggacttggatgaacgaatgtcatcaagtcgaaatatcttggctaaagaccgttttgaccaaccagtcttcctctttgaaaatgactttgccctccgctggtttgcggataagtatccagacgtagagttggaagagaagatgtgactcagtaccaacaattggaactaaagttcctaattgttggacgctagtcgctatttggcgaactagctaactgcctcactaactgagttttacaaatggaatcgatttgtaaaactcagtgtcgtaatctaataataggtaaccgctatggcggcttacctaaacgcttcactaggaaaaatccacgaatggtatcgattcgtggacttttccgtcgtagatagaaaagggtaactgccttactaactccgtttgcaaatagactcgatttgcaaaacttcgtgtagtggataaaaatactgcaaagtttgcagtattttatctcagcattctataaacagatgttgaatattaagccttatttattttattattaacctttatggkaataactttmcaaataaaagaaaacttcagatattcaccttttgtgattggtctgaagttttcttttttactgtccatatttttggtaaaagtcaacttttacttggatgaaggttttggcctcgcgtaggagttgaagaagggtggcgcgggtttcaaattcttctcttgtcttgggtagactacggttccggaagacttccagatagcgttcaatttcatctagcaaatcagaagcaggattggtctggctcagttgagctgcaatttttgaaaagagttgggccaaaatcaggctctcactggcagctaggtgacaggtgttgatgtgctgggccatgtttcgcaggatacgactttgtcgctgtctcatctcaaagtagtggatatggtaatcagtctggtgaaagaggtggtcagagtgatccaaatagaccagtctgagggcttcttccaaaagggtgtccaattcttcaactaactgtgctcggttgcgtccatcccctctggataaataatatttgaagcgctggagaatatcttttaacttttcttctaccaatgtgtggtagtgatgaatttcctcttctcgtgaaggcatgtagagattaaccagtaaggcaaatcctgtaccgatagcaaagagaaggaattcattgactaggaggtctggagaggttgacttttgcaccaagagatggctaaccaaaacgctacttggtgtgatgccaatttcccagcccatcttgtaggctagaggcacatagagggctagatagaggccgaggctccagatatgaaatccgctcaagtgaaaagccagaactccgataaccaaagctagaagcatggaaaagaggcgatttcgggccagttttaaggtacttctacgggtatcggataggctcaagagggcgatgattccagccgagacagctgaggagagattgagaaagtaagcaagaaggcaggcaagacaggtagctaagatgagcttagtcgtacgttggctaatagacataaggatttcctagtaagttataataaaagcggaaaagacaagacctgagcaggcttgtctttatgagttattttttacgggctgctgcgtattcggcaacagcagtaaagaggacatctgttgaagagttaagggctgtttcacatgagtcttggatgaccccaatcacaaatccaaccccaacaacttgcatggcaatatcgttagaaataccaaaaaggctacaagcaactgggataagaaggagggatcctccggcaataccagaagcaccacaggctgagattgctgctactacactgaggacaaaggctgtggcaaagtcaacagggattccaagagtatttactgcagcaagggttaaaacgttaatagtaatcgctgcccctgccatgttgatagtagaaccaagtgggatagaaacagaataggtatctggatccagaccgaggtcgtggcaaagtttcatattgacagggatgttagccgcagaactacgagtgaagaaggctgtaacaccgctgacacgcaaacatttccaaacgaggggataagggtttctcttcataaagaggaaggcaatcaatggattgacaaccagagcgacaaagaacatagttgtcaccaagagggcaagcaagattccgtagttagctaggcttccgattcccttatcagagatggttttgaagacaagaccaaggataccaaatggagctagattgatgatccattcgacaatcttagaagtcacatcagccatagttttcagcaattctttactatttttgctggcctctctcatagcaatcccgaaaacaactgcccaagataagataccgatgtagttagcagtaacgagggcattgactggattgtcaaccagtttgagcaagagattgctgaggacctggccaattccatctggtggtgcgatttctgtattggcactatttaaggtaatctcaacagggacgatgaagcttgctaggacagcaacaagtgccgctgcaaaggttcccaccaagtaaaggaggataaccgttttcatgttgctatcttgacccttttgatgttgggaaagggcattggcaacgagggcaaagactagaataggtgcgatggctttgaggccaccaacaaagagatctccaagtaaaccaattcctgaaatgttaggaagtgtcagccctagggttcctcccataagcataccaatcaaaatccgtttgattaggcttgccttattccaagcatgaatgatttttttcataacaatctcctttggtgtgtaatgtttatgattatagtataaatatggagctaaaatcaagaattttctgtctattttggctattatttttgaatatttatggagattcatcacttgtgaaactatggtataataaatgaaaggagttttctatgcaagaatttattcaaacctacctcaataagcattgatataacaacgattattgagaatatcttaaccaagttaatttctctgttatttctatttttgctattctatatagctaagaaactacttcataccatggtgcagagaattgttaaaccttctttaaaaatgtctcgccacgatgtcgggcgtcagaaaaccatctcacgtttattagagaatgtgtttaattataccctctatttctttttactttactgtatcttgtctattttgggcttgccagtctctagtttgctggcaggtgctgggattgctggggtagctattggtatgggagcccaaggctttctgtctgatgtcatcaatggctttttcatcctctttgaacgtcaactggatgtgggagatgaggtcgttttgacaaatggtcctattaccgtatcgggcaaggttgtcagtgtcggcattcgaacaacgcaactcagaggagaagatcaggttctgcacttcgttcccaatcggaatatcaccgtcgtcagcaatttctcacgcacagactagacctgttattttaagtaatttgtggtacaatagaaagagtttaataaaggagaaaagatggttttagaaaagcagttgggcaatggttgtacctggatagaccttgatgtggataagattaaaaatatggaagatctttctgacatctatggattggacaaggaaaccattgagtatgctctggatagaaatgaacgagctcatatggattataaccgtgaaacggagacggtaacctttatttataatgttcttgatttagaaaaagacaaagaatattatgaagcgattcccatgacctttatcgtcgaaagacaacgaatgattaccatcagcaaccataagaatgcttatgtcattgatcagatgtcagcttatctggatagccatgagtcgctttctatttacaagtttctctttgctggtttagagattatcagtaacgcttattatcctgtcattgaagagatggataaaagtaaggacgaaattagtgccttgctacgtcaaactacaacaaagaaaaatctcttcgccctctctgacttggagactggtatggtttacttgacagcagcagcaaaacaaaatcgactcctcttggaacatatccagggccatgctctttatcggagatttaatgatgtcgaacgagagcagtttgatgatgccatgattgaagcccatcagttggtgtctatgacagacttgatttctcaagtcttgcaacaactctcagcttcttacaacaacatcctaaacaataacttgaatgatagtttgtcaattttgactattatctccgtcttactagcagtacttgcggttattacaggtttcttcggaatgaatgttcctctaccatttacagaagagccaaatgcttggatttatatcttaatgactagcttgattttatgggtggccttatctcaatggctgaagaaaattactagaaaataaaagaaaaggagccaaaatggtgattgaaaactacatgccagactttgctgtggaagcagtctatgatctgacagtcccaagcctgcaggcgcatggaatcaaggctgttttggtcgatttggacaataccctcattgcttggaacaaccctgacgggacgccagagatgaagcaatggctacatgatcttcgggacgcgggcattcgcatcattgtggtatcaaataacactaaaaaacgcgtccaacgagcagttgagaaatttgggattgactacgtttattgggctctgaagcccttcacatttgggattgaccgtgccatgaaggaatttcattatgagaaaagtgaagtggtcatggttggcgaccagctcatgacagatatacgagcagcccaccgtgcaggcattcgctcgattttagtcaaacccttggtccaacatgactcgatcaaaacgcagatcaaccgagctcgtgagcgccgtgtgaagcgaaaaatcactgaaaagtacggaccgattacatataaaaaaggaatttaactatggaagaaattctctgtattggttgtggagcaaccattcagacgacagataaggctggtcttggttttaccccccagtcggcacttgaaaaaggtttggaaactggcgaagtctattgccaacgctgtttccgtctccgccactataatgaaatcacggatgtccagttgacggacgatgatttcctcaagctcttgcacgaggtgggagacagtgatgccttggtagttaatgtcattgatatctttgattttaatggctctgttatcccaggcttgccacgttttgtctcgggcaatgatgtcctcttggtgggaaataaaaaagatatcttgcccaagtctgttaaaccaggcaagattagccagtggctcatggaacgtgcccacgaagaaggacttcgtccagtcgatgtcgtcttaacttcggcccaaaacaaacatgctattaaggaagtcattgacaagattgaacactaccgtaagggtcgtgatgtttatgtggtcggtgtgaccaacgttggaaaatcaactctaatcaatgctattatccaagaaattacgggtgatcagaatgtcatcacgacttcgcgcttcccagggacaaccttggacaaaatcgagattccgcttgatgacggttcttatatctacgatacaccagggattatccaccgtcaccagatggctcactacttgacggccaaaaacctcaagtatgtcagtcctaaaaaggaaatcaaacctaaaacctatcagctcaatcctgaacaaaccctgtttttaggaggtctcggacgttttgactttatatcaggagaaaaacaaggatttactgctttctttgacaatgaactcaaactccatcgtaccaaacttgaaggcgctagtgctttctacgataagcacgtcggaacccttctgacaccgccaaatagcaaggaaaaagaagattttccaaaattagtccagcatgtatttaatattaaggagaagactgacctagtcatctcaggcctaggctggatccgcgtaacaggaactgccaaagtcgccgtctgggcaccagaaggcgtcgccgtcgtcacacgaaaagcaattatttaaacacagaaaggaaagggttgtctaaattcgtgcgtgccctgagagcccacagcgaatacttttcactgtggtgtcagttggtacaagtgattgtaccaactgcggaaaatttgagaccttaggctcaaattttagtcatgaaagtccgaaggactttgctgacgtccgtcaccacttcagaaaagtataaaaagaaactcttttaagaaaattatgtcattaacatcaaaacaacgtgccttcctcaacagtcaggcacataccctcaaacctatcattcaaattgggaagaacggtctcaacgaccaaattaaaaccagcgtccgtcaagctcttgatgcgcgtgaattgatcaaggttactcttttgcaaaataccgatgaaaatatccacgaagtagctgaaatcttggaagaagaaattggtgtggatacagtccaaaaaattggccgtattttgattttgtataaacaatccagcaagaaagagaatcgcaagatttctaaaaaagtcaaagaaatatagaaaaactactccaaacaactgtttttacagagaaataaaggagactagcctatggcaatcgaactattgactccctttaccaaggtagagttggagccagaaatcaaggagaaaaaacgcaaacaagttgggattttaggggggaattttaaccctgttcacaatgcccatctcatcgttgcggaccaagtacgccagcagttgggactggatcaggttctgctcatgcctgaataccaacctcctcacgtagataaaaaagaaaccatccctgaacaccaccgtctcaagatgcttgaattggcaattgaggggattgacggcctagccattgaaaccattgagttggagcgcaagggcatttcttacacctatgacaccatgaaaattttgacagagcaacatccagatacggattattactttatcatcggtgctgacatggtggactatctgcctaagtggtaccgaattgatgaactggttgacatggttcagtttgtgggggttcagcgcccacgctacaaggctggaacttcttacccagttatctgggtggatgtgcctctcatggatatctcatccagcatggtgcgtgacttccttgcccaaggacggaaacccaactttctcctacctcagccagtgctagactacatcgagaaggaggggctttactgatgggctatcaagactatattaactgttcccgtgaggctttgttggaaaaaatggcagagcttctacccgagaaacgcttaacccattgcttgggtgtggagcgtgcagctatagaattggctcagagatttagagtcgataccgagaaagcaggactagcaggccttcttcatgactatgctaagaagttgtcagatcaggaattcttagacttgattgaccgttatcagctagaccctgacctcaaaaactggggcaataatgtctggcatggtatggtcggaatttataagattcaggaagatttggatttgcatgatttagaaatcttgcgagctattgaaatccatacagtcggggctgaccagatgacagacctagataaggttatctatgtcgcagactatatcgagcataatcgatcctttcctggagtggatgtagcgcgtgagattgcaagtttgtcacttaataaggcagtagcttatgagacagttcgtaccgtggagcatctagcccatcagggattccccatctatccccaaacccttgaaacctataacgcctttgtgcactatttgaaagaggactaaatgaacgaaaaagaattactagaactagtcgtgaaagcggctgatgagaaacgtgcggaggatattctcgcacttgacgtacaagaattgaccagtgtgacagactactttgtgatcactagctctatgaatagccgtcagttggatactatcgctgataatatccgtgaaaaagtagcggaagcaggatttaaaggcagtcatgtcgaaggcgacgcagctggaggttgggtcttgctggaccttggtgctgtcgttgtgcatgtcttttcagaagaaatgcgtgcccactataacctagaaaaactatggcatgaggcggattcagtagatttatctgaaactcttgcttagaagacgaactcagttgcagtcaactgggtttctttgcttattttagaaaaaatggatagaaaggtatagggctagtagtgtttaccatggagctcttggtatcatgattatggcaacttatgaaacctttgcggctgtttacgatgctgtgatggacgatggtttatatgacaaatggacggatttttctctgcgtcacttgcctaaaaacaaggagagaaagaaactcttggagctggcttgtgggacaggaattcaatctgtgcgcttctctcaggctggttttgatgtgactggacttgacttgagtggggatatgttgaagattgctgaaaagagagcggcttcggccaagcaaaagattgattttattgaaggcaatatgctggatttatccaaggcagggaaattcgactttgtcacgtgttattcggattctatctgctacatgcaggatgaagtggaagtgggggatgttttcaaagaagtttataatgccctcaatgatgatggtgtctttatctttgatgtgcattccacctaccagacagataaagtttttccagggctattcttaccatgaaaatgcggaagattttgccatgctctgggatacctacgaggacgaagcacctcactccatcgtgcatgagttgaccttttttatcaagkaggctgacggttcctttagtcgctacgatgaagtgcatgaggagcggacttatgagatcctgacctatgatattttgctggaacaggctggtttcaaatccttcaaactttatgcggactttgaggacaaagagcctacagaaactagcacccgttggttttttgtcgcgcagaagtaggagattatcatgaccatcacaggtattatcgcggagtttaatccctttcataatgggcataagtacctgctaaatcaggctgagggactgaaaatcgttgccatgtcagggaatttcatgcagcgtggagagcstgctatcgtggataagtggacacgagcccagatggcgctggaaaatgggagcggatctggtagtggaattgccctttttagtcagtgttcaggcggcggatttcttcggccaaggagctgtggatatcttggctaggttgggcattgatagcctcgcttttgggacggaggaagttctagattaccagaaaatcgctgacttatacacagagcaggggactgagatggagaaatttgtggaaaatttgcctgattccctttcctatccccagaaaacccaaaccatgtggaaggaatttgcaggtcttgatttttcaggcaatacgcccaatcatgttcttgctcttgcctatgccaaagccgttgttggacacaacaccaaactgcatccgattcagcgtcagggggcgggctaccattctgtagataaagatgtggactttgcttcggcgacagctcttcgtcagcaccagaaggatcaagatttcttagaacgctttatgccttctgttgccctctttgagcaggccagtaaggtgagctgggaagactattttcccttgctccgctatcaaatcttgtcaaatccagacctaaccactatctatcaggtcaatcaagaaatggctgcgcgcattaaggaagctattaaaacagcccagtctgtggaagaattggttgaggcggttgcgaccaagcgttataccaaggcgcgtgtcagacgccttttgacttatattttggtgcaggctagagaaaatgacttgccagaagacattcatgtccttggctttaccgaaaaaggcagacaacatctcaagtctctgaaagagcaggtccatctagtcagccgaattggcaaagaaccttgggatgctatgacccaaaaggcagaccagatttaccaactgggaaatccaagtatagcagagcagaattttgsaagagtaccgataagaatagaaacaaactcagtctactgaaaggtggactttttctcaagtctctactaaactactatttctaaatmacaagtttattttagcaaacgcgttccaaattccccaaaacatattctattttaggtttgtgaaaatcacttttttatggtagaatgtaaaagaatgtatgtcattcggaataacaataaaatgaggtaaaaacatggaaatcatgtcgcttgcgattgctgtttttgccgtcatcattggtttagtcattggatatgtcagcatctcagctaagatgaaatcatctcaggaagctgcggagttgatgcttttaaatgctgaacaagaagcaactaatttacgtggacaagctgagcgtgaagcggatttacttgttaatgaagccaaacgtgaaagcaagtctcttaaaaaagaagcactattggaggccaaagaagaagccagaaaataccgtgaagaagtggacgctgaattcaaatcagaacgtcaagaactcaaacaaatcgaaagtcgtttgacagagagagctaccagccttgaccgtaaggacgacaatttgacgagtaaggaacaaacacttgaacaaaaagaacaaagtatttctgatagagcgaaaaaccttgatgcgcgtgaagagcaattagaggaagtcgaaagacaaaaagaagcagaactagagcgtattggtgctctgtctcaggcagaagcacgagatattatcttggctcagacagaggaaaacttgaccaaggagattgctagccgtattcgcgaagctgagcaagaggtcaaggaacgttctgacaaaatggccaaggatatcctggttcaagctatgcaacgtattgctggtgaatatgtagcagagtcaacaaactcaacggttcacctgccagacgatactatgaagggacgcattattggtcgtgaaggccgtaatattcgtacctttgaaagtttgacaggggttgatgtgattatcgacgatacaccagaagtggtaaccttgtcaggatttgatccgattcgtcgtgagattgcccgtatgaccatggaaatgttgctcaaagatggtcgtatccacccagctcgtatcgaagagttggttgagaaaaaccgtcaagagattgacaataagatccgtgaatacggtgaggctgctgcctatgaaattggtgcgccaaaccttcatccagacttgatgaagattatgggacgtttgcagttccgtacttcttatggacaaaatgtcttgcgtcattcgattgaggttgctaagttggctggtatcatggcgagcgaacttggtgaaaatgcggctcttgcccgtcgtgctggattccttcacgatatcggaaaagccattgaccgtgaggttgagggtagccacgttgaaatcggtatggaattggcccgtaagtacaaggaacatccagttgtggtcaataccattgctagccaccacggagatgttgaagctgagagcgtgattgcagttatcgttgctgcagcagacgctttgagcgcagctcgtccaggtgctcgtagtgagtctcttgaaagctacatcaagcgtctccatgatttggaagaaattgctaacggctttgaaggggtacaaaatagctttgcccttcaagcaggacgtgaaatccgcatcatggtcaatccaggacaaatcaaggacgacaaagtcacaatcttagctcataaagttcgtgagaaaattgaaaacaatctcgattacccaggaaatatcaaggtaaccgtgattcgcgagcttcgtgcagtagattatgctaaatamataagaaagagcagttgaaaaattactgcttttttgttacactagatagaaagactgtaaaggataatttggctttttgccgttattctagagaaatgttatttcacagactgactaaaaggagacacaatggcagaccgaggcttactaatcgttttttctggtccttcaggggttggaaaaggaacggttagaagagagatttttgagagttctgaaaatcaatttcaatactctgtatcgatgacgacgcgcgcacaacgtcctggagaagtggatggtgttgactatttcttccgcactcgcgaagagtttgaagagctgattcgtcaaggacagatgttggaatatgcagaatatgtcggcaactactatggaactcctctgacctatgtcaatgaaaccttggacaagggaatcgatgttttccttgaaattgaggttcaaggagctcttcaggtcaagaaaaaggttccagatgctgtctttatcttcctgacaccaccagatttggatgaattgcaagatcgtttggtaggacgtggaacagacagtgcagaagtgattgcccaacgaatcgaaaaagccaaggaagaaattgcgcttatgcgtgagtatgattatacgattgtcaacgatcaggtgcccctagctgctgagcgtgtcaaacgtgtgatcgaagcagaacacttccgtgtggatcgtgtcattggtcactatcaggagatgttaccaaagtctccaactactcgataaaatttagaaaataggtacaagcaaatgatgttaaaaccctctattgataccttgctcgacaaggttccttcaaaatattcactcgtaatcttggaagcaaaacgtgcccacgaattggaagcaggtgcaccaacaactcaaggtttcaagtctgaaaaatcaactcttcgcgctttagaagaaatcgaatcaggaaacgttacaattcacccagatccagaaggaaaacgtgaagcagtgcgtcgccgtatcgaagaagaaaaacgtcgcaaagaagaagaagaaaagaaaatcaaagagcaaatcgctaaagaaaaagaagatggtgaaaaaatttaaggttggggggactcaatcttattttttctattgcaagaatgtactgacaaggaggaggtgagaagatgcccatagccaagattattgtagatgtgcccttgatgcagacggaccagccctatagttacaggattcctgaggaatttctgggaatgctggaagttgggatgcgagttcatgtgccttttggtaagggaaatcgcctgattcaagggattgttcttggtttggagtcccaattggatgaagaagagatggagcaagatttaaaagatattgccgaggtactggatttttcccctgttctcacgcaagaacaactctggctggctgaggagctccgtaaatccgtcttttcctataaaatttctatcctcaaggctatgttaccagggtttctgaactctagctatgacaaaattctctatcctatggcaggtctgagtcaggaagaccgagagcgcttgtttggttcagaagattcgcttgccttttcttctctagatttaggtaagcaagctgaaatgatgcgtttgactagaaaaggcctgcttggtctagaatatcaggcgattgatcaaaagaaggtcaagacccagtcttggtatgaggtagaccttgttcagttagaaggtgtagagatttctacacgcgccaagaaaaagttagaactgagagactatctgctgtctcatccagagagcgcttctttggctagtttgttagagtcctactcgcgggagcaagtcaacttctttgtggaacaaggtgctgtgaccatagttcaaaaggaagttcaacgctcggctgcttattttgaagggattgaagcaagtcagcctttagagttgaatccagagcaaagacaggcgcgtgatgcggttgtcagtgcgattggcagtcatcagcctcctttcctccttcaagggattacaggaagtgggaagacggaggtttatttgcagattatccaaggagccttggacaagggcaagacagctattttgctggtgcctgagatttccttgactccacaaatgacggagcgttttattgctcgatttggtgagaaagtggccattcttcattcaggcctatccaatggtgaaaagtacgacgaatggcgcaaggtggaacgtggcgatgctcaagttgttgtgggtgccagatctgccatctttgctccgctgaaaaatctaggtgtcattataatcgatgaggagcatgaagcgacttataagcaggacagcaatccccgttaccatgctagagaggtagctattttacgggcccagtataatcaagcagcactggtacttggttcagcaactcctagtctggaaagccgtgctcgggctggaaaargcgtttatcaacatttacgtctgacccagcgcgccaatcctttagctaggatccctgaggttcaagtaattgactttcgggactatatcggacaaaatgaaacgtcaaactttacgccacctttgctagaagcgattcaggatcgtctggctaaaaaagagcaggtggttcttatgctcaatcgtcgtggttattctagctttgttatgtgtcgggagtgtgggaccgtggatacttgtcctaactgtgacatttccttgaccttgcacatggataccaagaccatgaactgccattattgtggtttttcgaaggacattcctcaggtctgtcctaactgtaagagccgaagtattcgttactatgggacagggacacagaaggcttatgatgagctggcagaactctttccgcaggcccgcattttgcggatggatgtggacacgactcgtaagaaaggtagtcaccaagctcttcttgaccagtttgggcgaggagaagcagatattttactaggtactcagatgattgccaagggattggattttcctaatgtaaccttagttggagttctcaatgcggatacggcattgaatctacctgatttccgttcttctgagagaaccttccagctcttgactcaggttgcaggccgggcaggtcgtgctgaaaaagctgggcaggtcttgattcagtcttacaatcctcagcactacgctattcgatttgcaaaggatcaggattacgaaggtttttatgcctatgaaatgggaatcagacgacaacttggttatccgccttactatttcactattggcattaccctttctcacaagaaagaagaagaggtggtcaaacgtgcttatgaagttatgaatattttgcggtcaggattgtcagagaccagtaacattcttgggccaacccccaaaccgattgctcgtacccacaacctctatcattaccagattttgattaaataccgtttagaagatgagctaagtccgaccctcaaccaggtcttagccttgactcaagaacgggaaaatagtgagctccgtctcagcattgaccatgagccacagcaatttttataagaaggagaagatatgacaaaattaatctttatggggacacccgacttttcagcaacagtcttaaaaggacttttgacagatgaccgttacgaaattctagccgttgtgacccagccggaccgtgctgttgggcgaaaaaaagtgattcaagaaaccccagtcaagcaggctgccaaggaagcagggcttcctatttatcaacctgaaaaattatctggaagtcctgagatggaagctattatgaagctaggagcagatggaattgtgactgctgcttttgggcagtttctgccaagtaaactccttgatagcatggactttgcggtcaatgttcacgcttcccttcttcccaaacaccgtggtggtgcgcctatccattatgccttgattcaaggggatgaggaagctggtgtgaccatcatggaaatggtgaaggaaatggatgcaggagatatgatttctcgtcgcagtattccaatcacggatgaggacaatgtcggcaccttgtttgagaaattggcgctagttggtcgtgatttgcttttggacactttgcctgcctacattgctggggaaatcaaacctgaaccgcaggatccaagtcaggtcactttctcgctaaatatcaagccagaggaagaaaaactggactggaacaaaaccaatcgtcaactctttaaccaaatccgtggcatgaacccctggcctgttgcccatactttccttaagggcgaccgctttaagatttatgaagcactaccagtagaaggtcagggaaatccaggtgagattctctctactggtaagaaagaattgattgtcgcaacggcagaaggggctctatccctcaaacaagtgcagccagctggtaaacctaagatggacattgcttccttcctcaatggagttggacgtacattgactgtaggagaacgatttggtgactaaagtagaaacggctagaagtttagccctagcagtattagaggatgtttttatcaatcaagcatactcaaatatcgccttaaataagcatttcaagggaagtcaactttcggcagcagacaagggcttggtgaccgagctggtctatggaacggtagcccgtaaactgactctggaatggtacctatcccactttatcgaagacagagaccagttagatagttggctttatgtccttcttctcatgagtgcttaccagctccgctatttggacaagattccagaccatgctgtggtcaatgaagcagtagaattggccaaagtccgtaaaaaaggcagtgaaaaattggtcaacgctgtccttcgccgtatcttgcgtgaaggctggccagatattgctagcatcaagcgaaaaaacaagcgtgattctattgcctattctcttccagtttggctagttgccaagctcaaggaagaatacggagaagagcgagctcaagctatctttgaaagccttttggtgcgcaacaaggctagtattcgtgtaacggacctaggacgaaaagaagaaatccaagtcttgttggaggccagtgattcacctttgtctgtttttggtctcgtcaaggagcaggggcattttgcaggccatgacctattttcagagggggctattactatccaagacgagtctagtcagctggttgctcccactcttgatttacaaggtggtgagcaggttctagatgcctgtgcggctccaggtgggaaaacagcccatatagcctcttatctaacgacaggtcaggttactgctctggacttgtacgaccataagttggacttaatacaagaaaatgcccaacgtttgggagttgcagatcgggttcaaatgcaaaaattagatgccagaaaggtgcatgagttttttggtcaggattcatttgataagattttggtagatgctccctgttcaggaatcggtcttctgcgccgaaaaccagacatcaaatacaataaagaaacggcagatttcgcgtccttgcaggaaattcagctagaaatattaggtagtgtttgtcaaacactacgcaaaggtggtataataacttatagtacctgtactattgtctcagaggagaactttcaagtcgtacaggcatttttagaaagtcatcctgaatttgagcaggttacactagaacatgaatgtaaggatatcatgaaagacggctgtatcctcattacacctgaattgtatggaagtgatggattttttatcagtcaatttcgtaagatatcggattaggaaggaactaacacatggaaatttcattattaacagatgttggtcagaaacgaacaaataaccaagactatgtcaaccactatgtcaatagagctggacgtactatgattatcctagctgatggtatgggaggtcatcgcgcagggaatatcgctagtgaaatggcggtaacagacctaggtgtagcttgggtagatactcaaatcgatacagttaatgaagtacgtgaatggtttgctaacaaccttgagattgaaaatcaaaggattaaccaattgggacaaaatgaagcctataaaggaatgggaacaacccttgaggctgtagccattattgataatcaggctatctatgcccacattggggattctcgtatcggtttgattcgtggagaagaataccaccagttaacgagcgaccattctttggtcaatgaattgcttaaggcaggtcaattgacacctgaagaagctgctagccatccacagaaaaatattattacccagtcaatcggtcaaaaagacgaaattcagcctgattttggaatgatcacccttgagccgggagactatctcttactcaatagtgatggcttgacaaatatgatttcaggcagtgagatttctgatattgtaaccagcgatatttctttggcagataaggcagcaaccttgatccgttttgccaacaatgcgggtggtttagacaacatcacagttgcccttattgctgttaatgaggaggaaacagaatgatccaaatcggcaagatttttgccgggcggtatcggattctcaaacagattggtcgaggaggcatggcagatgtttacttggctaaagatttgattctagacggggaagaagtggcagtaaaggtcctgagaaccaactaccagacagacccgattgctgtggcgcgtttccagcgggaagcgagagccatggcggatctggaccatcctcatatcgttcggattacagatatcggtgaagaagagggacaacagtatcttgcaatggaatatgttgctggattagacctcaaacgctatatcaaggaacatcaccctctttcaaatgaagaagcggttcgaatcatgggacaaatcctcttggctatgcgcttagcccatactcgaggaattgttcacagggatttgaaaccgcaaaatatccttttgaccccagatgggactgccaaggttacagactttgggattgcagtagcctttgcagagacgagtttgactcagaccaactcaatgctgggttccgttcattatttatcgccagagcaggcgcgtggttctaaagcaactgtgcagagtgatatctatgccatggggattattttctatgagatgctgacaggtcatattccttacgatggggatagtgcggtaaccatcgccctccagcatttccagaaacctctgccgtcggttatagctgaaaatccatctgtgcctcaggcattagaaaatgttgttatcaaggcaactgctaagaaattaacagatcgttacaaatcagtcgctgaaatgtatgtggatttgtcgagtagtttgtcttataatcgtcgtaatgaaccaaagctagtctttgacgatgcaactaaggcagatactaaaactcttcctaaagtaccgcaaagtaccttgacttctattcctaaagctccggtacaagagggaagacctcaacctaagccccaacctcatcagacagaaaaaacagtacctagttcaaagccaaccaaacgtcgtcgtatgaaagcacgttatccaattttatttgcgaccttcttgttggttgtggcatccttggtatggattttatatagaacgcccgctaccattgctattccaaatgtggcaggtcagacggttgcagaggctaaagaggctctaaaaaaagccaattttgaggttggtgaagaaaaatcagagtccagtgataaggttgaagaaggtcgggttattcgtacagaccctgaagctggtaaaacacgtaaagaaggaacaaaaattaatttgattgtgtcttctggtcagcagtctttccaactcggaaattatctcggaagaaagtccagtgatgtagtggcagaattgaagggtaagaaggttccagaaaatctgattaagattgaggaagaagaatccaacgaaatcgaagccggtacaatcatgaaacaaagtttaccggagggaacaacctatgatcttagcaaggcaactcaaatagttttgacagttgctaaaaaagtaaattctatttcaatgccaagctatattggttctagccgagaatttgcagtcaataatcttacagagatatatgacattaaaaaagctaatatcgaagttgtagaagtgtctaaagctcctgaaggaactgctgaggggactgttatagagcaaagtccaaaagcaggcgaaaaagtagacttgagcactactcgtgttaaaatttctatttataaacccaaaacaccaccatcaagttcctcttcaacgtcagttcaacgtggtaaccaaggttcacctactactccaaatcaagggaatcaacaaggtggccagcaaggaaatcaacaaggaacggttcctactccgagtcaaccaaatagtgaaggaaatcacgaaaattctcgtgattaaacgaatctttgtcatgatttcatggcaaagattttttttgactccggatttgtgatagaatagtaggagttgataaaaggaggaacgcatggaagaatcaagagaattaaatgccgtcatcgatgtgattatgttagcaggaaccattctccttaaaagtggttcagagattcatcgtgtagaagataccatgattcgtattgcgcattcgcagggaattttggattgcaatgttctggctatgcctgccgcaatctttttctccattgaaaataccaatatttcgcgaatgaaacgcgtgacctcctcttcttataatattgaaaaagtctgcgatgtcaaccagatttctcgtcagttggtaggggggcagattgatttagagacagcgttcaagcaattgaaggctttgcaagcccaacctcttccttatactaagttgcaggtaactctggctgcgacctttagtgctcctttcttttcaattatgtttagtggaaatatctacgacgcacttggggcaggagtggctaccttatttggttttgccttttccctctatgtagagaagtttatccgaattccctttgtgacagcatttgctggagcctttgtctttgggatgatagcccagttttgggctcgctacacaggttttccttcaacggcagatttgattatagctggtgcggtcatgccgtttgtaccaggtattgccttgaccaatgcggttcgtgatattatgaccaaccacataaactctggtatgagtaagatgtttgaatccctgctcattacccttgctttaggggcgggaacttctgtcgccttggtattgatgaactaatatgacactaacaacctttttattacaagcagtagcaagtcttcttgctataatcacttttttaatcgtactcaatgttcaacgttctatgctcttaccaggaggaattttgggcatggctgtctggctaatttatcttttgctcaaggaaccgaccaatgttattgtggctacttttattgcagccattatcggttcttgtgtcagccagattttaagtattctttataagacacctgctgtagtctttatcttggcaatcttggcacctctggttccgggttatctctcctatcggacaactgccttttttgtgacgggagattacagtcatgccattgctagtgcaaccttggttgttatgttggctttggtgatttccattggaatggctagcggaacagtgattcttagactgtattcttacttacgaaaacagcataatcgttagactaacaagagacttgatttggtgaatcaagtcttttttctctcttttactgctatttgtgataaaatagtatagaacgattttttacaatgaatgataaaacagaggtaaatatgacaatcggtattgataagattggttttgcgaccggtcaatatgtcttgaaattacaagacttagcagaagcgaggggaattgaccctgaaaaattaagtaaaggactcttactcaaggaattgagtattgcgcccctaactgaggatatcgtgaccttggcggccagtgcaagtgattctattttaacggagcaagaaagagcagaaattgatatggtcattgtagctactgagtcaggaattgaccaaagtaaagctgcagccgtctttgtgcatggtttgctgggcatccagccctttgctcgtagtttcgagattaaagaagcctgctatggagcgacagctgcccttcattatgccaaattgcatgtggaaaattctccagagtccaaagttttggttattgccagtgatattgccaaatatggtattgaaacacctggagaacccactcagggtgctggaagtgtggctatgttgattacacagaatccacgcattatggcctttaataatgacaatgtagctcagactcgtgacatcatggatttctggcgtccaaattactcaacaaccccttatgtaaatggtgtctattctacccagcaatatctagatagtttgaaaacgacttggcttgaataccaaaaacgctaccagcttaccttagatgattttgctgcggtttgcttccacttgccttatcctaaattagcgctaaaaggcttgaaaaaaatcatggataagagcctgccgcaagagaaaaaagacctcttgcaaaagcattttgaccagtctattctctacagtcaaaaggtgggaaatatctatacaggttccctcttcctcggactcttgtctctcttggaaaatacagatagcttgaaggctggggataaaattgccctttatagttacggaagtggggctgtagctgagttctttagcggtgaattggttgaaggatatgaagcttatctggataaggaccgtttgaacaagctcaaccaacgaactgccctgtctgttgcagactatgaaaaagtcttctttgaggaagtagagttagacgaaacaaattctgcccagtttgctggctatgaaaatcaagattttgccttggttgaaattgttgaccaccaacgccgttatagcaaggttgaaaaataatgaagataagttggaatggattttctaaaaaatcataccaagagcgcctcgagctgttaaaagctcaggcgctccttagtcctgagaagcaagtgagtttggagcaggatgaacagattagtgtgactgtggcagaccagctgagtgagaatgtagtgggaactttttctctgccttattcgctggtcccagaggttctcgttaacggtcaggaatacacagttccctatgtgacagaagaaccctcagtggttgctgcggccagctatgccagtaaaatcatcaagcgagcaggcggttttattgcccaagtccatgagcgccagatgattgggcaggtagctctttatcaagttgctaatcctgaacaagcgcaagagaaaattgccagcaagaaagccgaactcttggaacttgccaatcaagcctatccttctatcgttaaacgtggaggtggggcgcgtgatttgcatgtagagcagatcaaaggtgaaacagactttctcgttgtttatctccatgtcgatacccaggaagctatgggagctaatatgctcaacaccatgctggaagccttgaaaccagtcttagaagaactcagtcagggacagagtctcatgggaatcctgtctaattacgcgaccgattctctggtgactgcaagctgtcgtatcgcctttcgatacttgagccgccaaaaggatcaaggacgagaaattgcggagaagatagccttggctagtcagtttgcgcaggctgatacttaccgagctgctactcataataaagggatttttaatggtatagatgccattttaatagccactggtaatgactggcgtgctattgaagcaggggctcatgtctttgccagtcgagatggacgctatcaaggtcttagtcaatggacgctggaccttgaaagagaagaattggtcggtgagatgaccctgcctatgcctgtagcgacaaagggtggctctatcggtctcaaccctcgtgtagccctcagtcatgaactactgggaaatccatctgctaaagaattagctcagcttatcgtgtctatcggtcttgcccaaaactttgcggctctcaaagccttggtgagcacagggattcagcaagggcacatgaaattgcaggccaaatccttggctctcctagcaggtgccagtgaatctgaagttgctcccctagtcgagcaacttatcgcagataaaacctttaaccttgagacagcccagcgctatctcgaaaatttaagattataaaaaactcagacgaattggtctgagttttcttgtgcttatactcaatgaaaatcaaagagcgaactaggaagctagccgcaagctgtacttgagtacggtaaggcgacgctgacgtggtttgaagagattttcgaagagtattaaatactttttccaggtaatagggtaactggtaagaagtagcctgttgtcgcaacttccttaccttcgatcttctgcaagagaagatcaacagtgaggcaggcaatctcttgcaaaggttgcttaattgttgtcaaatgagggtagtagttctcgataaaataggtcccatcgtagccgatgactttgagctcttcaggaacagaaatgcctagttcttgagcaattttaatgaccagaatagctgtcaaatcatctgaagcaaaaatggcatctggtttttgacgagtcaagatattcttgatttccatttcttttctgacgggagaaaagtcactggaaatattgataataggcgcttttgggagtacggatgcaaaaccagcgtggcgcagtccggttggcgaattggaattgtcattccctgtaatcatgatgatagactgggcgcctgtcttaaccaaggtctgggcagcaagaaccccaccagcgtagttgtcagaggaaacgacagggatgtctggagataggtttcggtcgaaggaaataatcggcgctgtcacgcgattgtagtcttcaattcccaagttgtgactacccgaaatgatgccgtccacctgattggcttccaacatttcgatgtattcgcgttccttttcagaatcgtgctcactgttgcagatgatggtcttataaccatttttgaagagttggtgctccagcttatcaatcaattctgcatagaaaacattggaaatattggggaaaatcaagccgattaacttagctgattttccttgcagactacgagccaggttgttgggtttatagcccaattctcgcatggcttcattgaccttttgaatggttttctcagatagataaccttttttattgataacccgagaaacggtagtagggctgacgcctgcaagtttggcgacatcagttagttttgcgaccataatctaattcatagtaagttccagttgggtttccagatttgatgaggataccattttggtccgcatgtgggaagacacgaccagaaaatactttttctcctttattgatgaaaatttcaaagacagagttatcaatgaaaattgtagcagtagtagcctgattatcgatagggcaagagcgagttgtcccaaattcttgggcatactgttcaccagcctggctacgatctactgtcacttgaccatttgcaaggtcaaagttgatggaaagtcccttgccttctttatcagcaagtaagacaatctcgctctggctattaggttccaagttgagttcaagttcgtagctgttattggtttggggacggtttgagaaggcttcttcagaagcacgaaggtccttgatagtcgcgactgggtattggtagagtttgccatctttgatagttagttctttgaccaaagagaaggttccttggtggtcaaaacggtcagatgggtaagaaacatctggcaaaccaagccagctaacagctagagcacgtccatcaggagcgttgaatgcttgggttgcataggcttcaaaaccaaaatccatattttggagttgagacacatctaccattttggcattttcagggtcaaaggaagccccaattttatacatatttggatagatattatcgtagtctagaacatctttatccaatccttgtgggcagtagagaaggacaggttgctctcctacaaagaccagatttgggcattccatcatgtaggcagtgcggtcgttagcaaagtcaaggtcgccaacagcttgccagtttgtatagtcgttgtcaacagccttgtagagacgaacgaagccttttttctccaaatcctgtcctccgacgatagcataatattgacctttaaaattaaaaatttgcggatcgcggaagtggtctgtagagtctgctggctggtcgattaagatcttgtcaatcttcgtaatattgccatccttatccatcaaagccccgatctggtatgggtgacgaatccagttttcatcacggacatttcctgtatagaataggaacaagttatcgctaaattgcatagcagaaccagagtaggcaccgtggctatctaatggagtatcaggcaaaactttgacaccagtttctgtgaagtgaaccaagtcctcactttccaattgcacccaagatttcaaaccgtgggctgcaccgaaaggaaagttctgataaaaaataatccactttccatcaaagtaagaaaagccatttgggtcgtttaggagtcctgtttttggctcaacatggtaatgagtatgccatggagattgtgccatattttccttaatattcttaatttcttcttgcgtccagtcttgataaagtctgtaacgacgctcagtagtccattccattcattcattcctccaaaaatcttatcacatttaatagtaaccgttttcgataaaaaatgcaagccttttatgttaaaaaagagaaaaaactgttaaacgtttatcataaatttaaagcaggaaattaatcaacttttcaagaaaatatgaaagataatgaaacaaaagccttttaactaagatttcaaacttgttttttaaggaattcctgctaaaacagtcaaaatcaatcaatctaaagcgagcttactaagtggatagaatattttttctgcaaaacgcttgacatatttctaaaacatgataaaataatagtcgtaagggcggataaaatcgctttcaaacaagaacaaaattttatataaggagatttttgcaaatgaacaatcaggaaattgcaaaaaaagtcatcgatgccttgggcggacgtgaaaatgtcaacagtgttgcccactgtgcgactcgtcttcgtgtcatggtcaaagatgaaggaaaaatcaataaagaagtgattgaaaacttggaaaaagttcaaggtgctttctttaactcaggtcaataccaaatcatctttggtacaggtacagttaacaaaatgtacgatgaagttgttgcacttggtttgccaacatcatctaaagatgacatgaaagcagaagctgctaaacaagggaactggttccaacgtgctatccgtactttcggtgacgttttcgttccaatcatcccagttatcgtagcgacaggtctctttatgggtgtgcgtggtctcttgactgctcttggaatgacacttccagctgatgtgacaacttacactcaaatcttgacagatacagcctttatcatcttgccaggtttggttgtgtggtcaaccttccgtgtattcggtggaaatccagccgttggtatcgttcttggtatgatgcttgtttctggctcacttccaaacgcttgggcagtcgcttcaggtggtgaagtaacagctatgaacttctttggtttcatccctgttgttggtttgcaaggttccgttcttccagccttcatcatcggggttgtcggagctaaatttgaaaaagctgtccgcaaggttgttccagatgtgattgacctcttagtaacgccattcgtgacacttttggttatgtctatccttggactctttgtcatcggaccagtcttccacgtcgttgaaaactacatccttatcgctacaaaagcgatcctcagcttgccatttggtcttggtggtttcttgatcggtggggttcaccaattgatcgtcgtatcaggtgtgcaccacatcttcaacttgcttgaaattcaattgcttgctgctgaccatgctaacccattcaacgctatcatcacagctgctatgacagctcaaggtgctgcgactgttgcggttggtgttaaaactaaaaatccaaaactaaaaacacttgctttcccagctgctctttctgccttcctcggtattacagagcctgctattttcggggtgaacttgcgcttccgtaagccattcttcctttcattgattgctggtgcaatcggtggtggattggcttctatccttggacttgctggtactggtaatggtatcaccatcatccctggtacaatgctttacatcggtaacggacaacttgcacaataccttcttatggtagctgtatcattcgttcttggtttcgctcttacttatatgtttggttatgaggatgaaaaagaagttgctactgaagtagagacagaacgtttggttcaagaagaaacaactggtaacattccagcagctcttcaaaatgaaacacttgtaactcctattgtcggtgatgttgtagctcttgctgatgtcaatgacccagtcttctcaagcggagctatgggccaaggtatcgctgtgaaaccaagtcaaggtgtagtatatgcaccagctgatgctgaagtctcaattgcctttccaacaggacacgcttttggtttgaaaacaactgatggtgctgaagttttgatccacgttggtatcgacactgtaacaatgaacggtgaaggttttgaagcaaaagttgcccaaggtgataaggttaaagctggcgatgttcttggaacatttgactcaaacaaaatcgctgcagctggacttgatgatacaacaatggttatcgttacaaatacagctgactacgcttcagtagctccagtcgcaacaggttcagttgctaagggggatgctgttattgaagtgaaaatctaatactcttcgaaaatcaaattcaaaccatgtcagcttcgccttgccgtagatatatgtaactgactttgtcagtcttatctacaacctcaaagcattgctttgagcaaccttcggctagcttcctagtttgctctttgattttcattgagtacaatattccctctcaaaatgaaaacgaacaaatgacatgtttgttcgtttttgcttgaatggtaagatttacagaggaaaatctaaaaaatagagaaatttagcctttcgaaatatgctataataaagaaaataaaaacaagaggtttatcatgacaaaattatatggaagcttggaagcgggcggtacaaagtttgtctgtgctgtcggtgatgaaaactttaacgttgtagaaaaaacacaatttccaacgacaactccaatcgaaacaatcgataaaaccatcgagttcttctcaaaattcgataaccttgctggtcttgcagttggttcatttggtccgattgatattgataaaaactcaaaaacttatggctttatcacgacgactccaaaaccaaactgggcaaatgtggacttgcttggtgcccttcgtcgcgccctcaacgtgccaatgtacttcactacagacgtaaacagctctgcttatggtgaagtggttgcccgtaacaatgctggtggccgtatcgaaaacttggtttactacacaatcggtacaggtatcggtgcaggtgttatccaacgtggtgagtttatcggtggtgtgggtcaccctgaaatgggtcattattatgttgctagacacccaatggatattgaaaaagagtttaagggtgtttgtcctttccataagggatgtctggaaggctatgcagctggtccaagtttggaagctcgtacaggtgtacgtggggaaaatattgaactcaataaccctgtttgggatgttcaagcctactatatcgctcaagctgcggttaatgcgacagtgactttccgtccagacgtgattgtctttggtggaggggtcatggctcaacaacacatgctggaccgtgtccgtgagaaatttacatctcttcttaatggctacctaccagttccagatgtgcgtgaatacatcgtcactccagcagtcgcaggaaatggttctgctactcttggaaactttgttcttgcaaaagaagtttcaaaataaagcacaaaatccgcttgggaaaccaaacggattttttacatgtcaaagcatttgccagaaaaagtcgataatataggtcagaccgtaggtataaaccacgagagtaaagggcttggtcagaatgatgatagtcatatagcgcttgaagctcatcttggtcagggcagccagcatacagagaaagtcagctggactaatgggccaaatcatcataaaaataaagaaacggtcaaaacgattacccttatccaaccaaccgatgtacttgtcataggtgcgcttgctgacgacagactggacaaaggcagccccatagaggcgcaccagataaaagataatggcacagccaatcacgatgccgatatagttgtagatagtcccgatgatgtgcccgtatataaagactccagccaccgaggtcaaggcccctgggatgatagggacgaccgtttgtaaaatctgtaaaaagataaagagaggtggcccccagatacctgcctgctggataaaggcagagagggtttctttagactgtaaaatcccagcctgataagcccaaatacagaaaagcaaactcccaactccacctacaatcgatgagatattgataacttgctgtaaaaggggagaaactgctttcatttgtttatcctgtgacatgtaaactcctcatagatagtataactctactataccatattttggaggagaaagggggaatgagtctttttgctatgggaagagtgatggaatttgaggctaaacatgctataatagacctagtataaaatttggaaatttcaggatatgaatagttcaaatgaaacgtaaggaaggtttgcgatggcaagacgaaaagatttttctgaattaacaagagtacaaatcccagcagctctgcatttgatgcgaatgggttatacctatctttctcgtaatagtaaagaaattgaagaaagagatccagataccaatattcttgtatctgtttttaaagagcaatttttaacgtttaataactatttaacagatgaagattttgagagagaattggccaatatcaagctggaactggatcaaaatgatttagggcgctccttctttaaaaggatacagggacaagaaggtgctgtttatatcgattgggaaaatcctgaagccaacatcttccatctggcgcttgaagtcacttgtcaaaatgggcaagatgaatttcgcccggatatagttgtgtttatcaatggacttcccctttcttatatcgaagttaaacaacccaatgctatccgtgatggaaagacagggattcagtcagaacaggacagaaccagataccgttttgaaaatcgtaagttccgtcgttttaacaatattactcaattgatagctctatcagataatttaccttatatcagtggccaaggtcaacaaaaacagggttcttactacggttcaaatgcctattcaaaaaccaagtttaatgctttcaaggaagaaagagaagtagattttctgaattcaattgtacctttaagagatgaacaaattgatttcgtacttgaggatgtgaagcgttttgctctcaaatctcaaccagaatttacaacaaatttacagcccgagactccttgcaatacttttctatcatctttgtatcaaaaagaacgcctgcttttcatgcttcgctttgggctggtctatgtagaagaagaaagcaagggaggtcagatgcaattgcagaagcatgttatgcgctatccgcagtattttgcaactcgtgctatcgaagagactatcgcaagaggtatcaagaagggcgttatctggcatacacagggctcaggtaagacggccttagctttctttaatatccgctatctgaccaattatttctcaaaacagggcattgtccctcagttttactttgttgttgatcgcttggatttggcagaccaagcctttaaggaatttaccaaaagaggtctaaaagttaagcgcatcaacaatcctcgagaactcaatcaaaaacaagatggttatgatgtcgctgttgtcaatattcagaagttcaaagatgattcagacctgaccgaccgctctggctatgatctcaatcgtcaaaatatttactttatcgatgaagctcatcgctcttataacgaacgaggttcctacctgccaaatctataccaagccgatactaatgcgatcaagattgcattgactgggacccccttgattacctataagaaagatggtaagaccaaggaaagccatgcgactacacgtgatatttttggggattatattcataaatactactacaaccagtctatagatgatggttttaccttgcgtttgatgcgagaagatattgagacgtcctataaagataatctcagagccataaatgaagaaatccaacgtggggatttatcaaaagaagatatctttgctcatccgcactatgtggaacctatgcttgattttattctggaggactttaatcgtgcgcgtgatctggtttttgatgaccagactattggtggtatgattgtctgtgattcgtccaagcaggcgcgtgagcttgaaaaacagttagaagaacgacgaaaggctggaacaaccaacttgacctctgctctcatcctccatgatgagggagacaaggaagagaaaaaggaaaaggtggatgcctataaagaaggtaagattgacctcattatcgtctattcgatgctcctgacaggttttgatgcgcctcgcctcaagcgtctctatctaggtcgcaagattaaggctcataaccttctccagactttgactcgtgtgaatcgtccttacaaggactatctctttggctatgtagttgattttgcggatatttctaaagaatttgacaagactaatcgtgcttatttggaagaactcaatcaagaatatgatacgatcctgactggggaaaatggagaggatgtgtttgggtcgctctttgtgccagcagaggaaatttctcaggaactaagcaagacagagcgcatcctcatggactatccaacctctaatctagagttcttttctcaatcaattgatgatatcaaggatagaaagcaactaaatgaactacgaaaagccttagaatcggttaagcagtactataatatcgcccgcttactcggttatgaccatttgattaagcagattgatattgctcagattgcaactctgctcaatgtcatctcaagacgtttgctgaccttgtccctgatagataagccagatgacttttctagtcgcactcttttaaatcttgccatgtctgagaccagttttagttttgtcaagattgcggaggaagaactccgtctagcagccaatgacctagaaaatttgaagcgtcgagttgctggaggcatcataaaacagcgtgatgagaaagatcctgagtgggtttttctctacgaagaattccagcgcatcatgaaaaaacacttaatatatggacaagaaggctacactatggaaaacatcaaagaaattcaaaaagagtatgaagacctctttaggtcagtggaaaatcatcgtactcatatgagacgtttgacaatgaattttggcggagatgaaatggcggcacgttcctataaacacgtgaccaactcgactatggtaagcgagtacccagcagtttatcatgtcattaaagattctaaagttgcactggaccacaaaatcggtcaaaatcaaggagtgcttgataatgaggacttcttcaaaaaaatgattcgagaagtcgctcgaattgcaatgaaaaccaaccaatctgcaagtgatttgacaagacaggtttttaacgatatcgtcgagtcgctatttgaaggatatgaagaggaataccaacactaatgaatgaaacatataaagttcaagtccaagacttggtagatgatttgaaagcagtctttacccatgcgggcctaggaggggaagcgggtgaatacaaactccttacccagtccttcctctacaaatttttaaatgataagtttttatatcaggcaaagtgcctagatgaagttaatacttatgagcacttattgactttgagtgaagatgactatgactggctcttggaggatatcggtacaagtacggcttggctcaagcctgatcagttaatcgaaacccttcaccgtcagcaaaatgaagcgactttctacgagagttttgaaaataccctcaaccagatcgctattgacaataacgatatcttctcagtgcatacggacggagatacggctattcgtctctttgacgagcgtttgattacagataccatctcagatagcagtaagcgtaacgaagtggcaaaagctatcatcaatctccttgcacgcgtcaagtttgatgagagcattttttcacaaggctttgactttttttctactctctttgagtacatgatcaaggactacaacaaagacggaggtggcaagtatgccgagtactacacgcctcactctgtggctaagattattgcagatattctggtggggaatgaccaaccatcaaacgtgcgaatctatgacccgtcagctggttcgggaaccttactgatgaacctggctagtcgtatcggtgtcgataagactactgtctacagtcaggatatctcgcaaaaatcatccaacctccttcgtctcaatctgatcttgaatggactacagcattccattcataatatcgtacaggggaataccattatcgctaatcgccatcctgagaagatggactatatcgtgtcaaaccctcctttcaagctggacttttcagagtggcgtgaccgagtggaaagtttgccagaagccagtgaacgtttctttgcaggtgtgccaaaggttccagctaagtctaaggataagatggcgatttacgagctctttgttcagcatatcatctattccttgaagccagatggtcaagcagccgttgtcttgccgacaggatttatcactgcccagtcagggattgacaaggccatccgtcaacacttggtggatcatcaaatgctggcaggtgttgtctctatgccgtctaatatctttgcgacgacaggtaccaatgtctccatcctctttatcgataagaaaaacaagggcgatgtcgtccttatcgatgcctcaaacctcggaactaaggtcaaggaaggcaagaaccaaaagaccgttctttctcctgaagaagagcagaagattgtcgagacctttatcaagaaagaagccgtcgaggacttttctgtcactgcctcttatgaggaaatcaaggagaaaaactactctcttagcgcaggccaatactttgacatcaagatcgactatgtagatatcacagcagaagagtttgaagctaagttgaccgcctttcaaaatagactctcagatctattccagcaatcgcatgcattggagcaggagattgaagggcagatgaaggggttgaagtatgagtgagaagctaagtgatgttgtaactataattagtggaggtactccaaaaacaagtgtaaaagaatattgggatggagatattgattggttagcagttgcagactttaatacttcaaatcgctatgttagtactgcttctaagaaaatcacggagttaggattaaataatagcaacacaaagatgttagagaaaggcgatttaattatatcagctaggggaactgttggagctattgcacagttaaccaaacctatggcctttaatcaatcatgttttggattaagaggtaagaaaaataagttagaaacagattatttatattattggcttaaaaattatgtggatattttacttaacaaaagtcaaggcagtgtgtttaatactataaatttatccacatttgatgatatcaaaattgacttacctaatattgaaaatcagagatcaatttctaatttcctaactttacttgataataaaatccaaatcaacaaccaaatcaaccaagagttggaagccatggctaagaccctctatgactactggtttgtgcagtttgatttcccagaccagaatggcaaaccctacaaatcatcaggcggaaagatggtctatcacccagaactcaaacgcgaaatcccagagggatggggagtggagaagttgaagtattttctcacaattaaaaatggtaaagatcataagcacttgcaagatggtaagtttgctgtatatggttcaggtgggattatgagaacagttgcagactatttgtattcaggagaatcaattctctttccaagaaaaggtacattaaataatgtaatgtacgtaaatgaggaattttggactgtagatacgatgttttattcagaagttaataaaaataattctgcactgtatgtattctattcagtaaaagatattgattttaataaattaaatacaggaacgggagtcccgagtatgacttcttcaattttatatgatttaaatataattgttcctgaagaaaatattttagaaaaattcaatacgatagttaaacaaaactatgaaacaatcaaattaaataatattcaaaaccaagaacttaaccaacttcgcgattggctcttgccaatgctgatgaatggacaggttataatctaatgtttaggagataatgatatggaaaagagattaaggttatttcatttttctaaagatcaatacggagaaccgtattatgtaccaggtataatttttgacgattctttcgcagagttcagtaaaattgtagaagatttagattctagaataaataaatgtattgatgataaatatgctaagaatatcagatttaagacaccttcttcacagatggtaacaaatgtatcagagatttttgaaaatgaagagaatttcgatagaaactcagaagacattgcaagtaaatttcaagactcaataggacgtaggtttcaaaatgatttttatttagtagtacttacaactgaaattgaaagtagagaagtcctttttcttgttaagatggaaacaggaactgctatccaggtaactgatgaaaacacattaaccacattagacaagattcttccagataagaaatcaagacttcaaaaggctactgtaatctacaaagataaaacaatccagtttaaagaaaatagagaagagccgaattcagaaagagaaaatatccactcaagagttttggataggactgacgagaatatttctggttatttcttcacaaaatttttggatagtaataacgttatagatgatgaagattcagcagctagaatggctatacaagcgattgaaactgtcgttaaaccatacataaagtctgaagtgagtccagaaattgtaaaagaaaagttaacaagttttttatctcagagaagagatacatcatttgaagggctgattcaagaggttagtgatgtattaaactttaatatagaaaatagagaaacagatatagaaaaattatcacaggaagcatatgatttagcgaaaagaaaaaataatactgttgtagctagtttcgtagcaaagttatatcgtccacctaaagtaacatatgtagctcagggagatgaacaacaaattaaaataagctttcttaaaagtctagagactcatagagatgtttattgggatgatgacgacgacgatttttacgttttaaaaattaacaaagaagtaattactctgattgagaggtgattacattgattaaagaacttattaaatatattgacgctttcaatgatgttgtcggacgtattaatattgattataaagaaaataagtttatctacattttagagttcgaaatttcagagaaagagttagatagttttaaggaaaagatcaatagttataaaataaatgaactggatataacttgtaataattacccgttggagtcctgtaaagaaactaaggaaatcaatagggttgctgtaacaatgaaacaaaaccaatttcctttagaggaccaatcattatattttagaaacagcaatgacttttatacatttgaaaaaaagtttttaaaaaagacaacattcaaaagtctagaaaataggaatacaaagataagaatttggattccagaagaaaatagtgatatatattcgcctgttttttcattttatgaagaaagtttagagatacctgatatattaatttcaaaaacggaatttaatcataatatgctttgcgctcttcctaaaataatttcagatagaaattttgatgaatttaaaatcgagacacttgatggttttctaagtatagtttcggaaagaaaaatatccaaagatgaatatattataagttttgaaaaaaatgctattttagaaatgaatagtattgaaatagataatataggtttatttggtgttctcaatcaattatttgattttattttttatgatgacaaaacttattatgaaaagttgataatttttagaaatgttttttctgaatttatcaagcgacaaaatacaattaataatatggattttcaatatattttaaaaaatgtacaatcgaattataatttatttatcaatgataaattgaaaaagtttatatctgataaacaaaagttaacagaagatttttcaaaactgcaaaaagagattttgattagtataaaaaatatttctaatacaatatctcagcaatttttagttttaattgtaacaatattaactacctttatttttaaaaattttaatacaaggctagcgatgtctttaactgtatattctgggatattttatttaatttgtataattatagtaaacaaagtgagaggatggagttttgattctaaatctataatatcagagtgcaatgatattgataaaaactataatatgttgtacagtatagatgaaagttatattattgctttgaaagaatctgagggctataaaacagaattagaaaggttgaaaaaaattgagaccttatataaatggttgatttatagtcttttattcattttgatagttatattgattctgatttataaacataatgaattgtatgatcaaattaatttgtataaagaaatagttgatttgttactaccttaaaatttaaaaaagagcaacattctcaaaaaaagaagcaaatagattgaaatggttactttatatacgttctattgaggagattgattttactgaggtggaagaatggataagtgaaggcagatttggagactaaaatgaaaaagagtttttcgaactcagagaaagaaattttagatttgatatatattccgattgagcaagttactaatttagttggaagctcggttcagtattgtaacaatattcttgtcagaaagaatgaatcgaattattttgttgtgaatgataatatctcagaaattgaatttccggatgaatgtgaaacaggctatattgagtgccactcaagagatgaatatgaaagacctattggagctaaattttttatcaaacaaggagatggggaatataagagaggtaatacagttaacccttctttttgggacatcttaaacaaaaatgatgattatgaaagtttttttcatagaggacatatcatagcttcggtatttggtggagacaaaaaaattcccaataccagaaatagagggaaattatcccagttcattcagacgaagtggagcaacgagaatgattacgggttaaatccatactgtcaatggcgttttgaagagaaaattaaagaaagagtagtgacagattcagtttgtattgattctcgtctcatttatcgaaataaggcagataagattccaattggaatacacatgcaggcagtaacaaagagcgaatctctattcaatgtctttattcctaatattgatccaaatataaaaataaattataaaaaatgcacatttaaattaaataagtaatcgcatccaagtaaaatataactttgtttccgtatttcctgggaactagtagaaagttaggagaaatatgggaaacaacaaccaacgtgccctttgccaacaactctgggctagaaacaaataccttgtcttgagccattccagcaatatttacaatgagattcgccaatatctcaagcaagaagtggtggaggtgagtcaggttcaagagatgattgaccgagcttgtcaaatcccagaacataggggtcaggtttgtaatgcctttcagcatatttggggctattttaaaaagaaagcgacagatgctgagcgcaaggactacatgatcctgctggatcgctaccgctttggtcaggcttccaaggaagatgtaatcgctaagactcgagacttgcttgattgctatccaaatacctacttgcaacattcgactttactgaaaggagactcccatgagactttggcatgagactttgatttcacaacttccccggcctcaacttttggggcaacatcgagagtgttgcgccctgcgtggcaatggttggggcagaaagcatgcgacggtggattatgtctttacccactcgccctatcgtctctatgcctatcatcgcttgattatggaggagatggctgaccgtggctacaatgtcagtccagagtggttggataaaaactatcgtggtaagacctgccctacttatcaagaattagtagaggaaaagttgactagtcctatatacagcgaacatgacgcaacctactatgaggagtgtctggcaaatctccgagagaaggggatagagctggaataatagtaaggattgccttcaatttataactcttctcgtattttttcgaataataaagatgagacctttggaatttttctaaggtcttctttttatgaatgttaggatttacttttaataacttttaagttataattaaattagaaagaggttgctaggtgcatacgatttacttctataaggacaaaaatggaaatgagccagtcttggattatatgagagaattggcctgtcgtaaaagtaaggatagccgcatcaaactcaataaactaaatgactatatcgagttacttagtcagcaagggaccagagctggggaaccttatatgaaacacttggaagatgagatatgggaactaagacctttgagagatcgaattttatttgtagcgtggcttgatggtagttttgttcttttacatcattttgtcaaaaagactcagaaaactcctagaagagaaattgaaaaagccaagcgtgaactgaaggacttaaaagaaagaggggtaagtgatgaagaatagtgctattgggagtaactggaaggatgtcaggtcagaactctttaccaaggaggaaatacttgaaagtgatatgcgagtggctatcatgagtgagttgattgaagccagacatgagcaaggaatcagccagaaaaagctagaggaactcagtggagtgagccagcctgtcatagctaggatggaaacaggaaagacaagtcctcagttggatacagtcttgaaagttttagccagtttaggaaagacactagcagtcgtcccacttgaacagagaaagagttgataggaagaagttggaaaactttaacaaatttaacagttatagtgcctcaagtgtataatatagaaaaattatgctttatttatatcaagtgcgaacgaagtgagcttttagcggatatttcccgctatagtggtattctagataataatttattattatctagaacggaatttttgagacattctggctcaaaaattagggatgaaattacgaagtgagttgctcccgtccgcacttttcagggaaatatcagaattacaaaagaaaaatcaacctatagtcttttctaataacaagtcatagtcacttataagaattactaataacacgtttgaagagcctaactgcaatagagctataaaacaagatatacaaaggatttgaggcatgtgtctcaagtctttttcttttgtctaaaatagaggtatagtttcaaactatatcaaagcctaattttttacaattatacagatgatttcttttctgttaagatagtttcaacaacaaattttggaggacacatcatgtcaactacaatcatcggtttccctcgtttgggagaattccgcgaattaaaatttacaactgaaaaatactttagaaaagaaatctcagaagaagaactcttggcagcagcaaaagacttgcgtgctaaacactggaacattgtcaaagaaaaaggcatcactgaaattccatcaaatgacttctctcactatgacaacttcctagatgcagctttccttttcaatgtggtacctgcttcagttcaaaacctggacttgtctgaccttgagcgctacttcgctttgggtcgtggttaccaaggagaaaaaggggacgttcgcgcccttccaatgaagaaatggttcaacaccaactaccactacatcgttcctaagtttgaaaaagacactcaagtcaaacttgcaggtcacaagatcttcgatgagttccaagaagcaaaagaacttggattgaacactcgtccagttcttgtaggtccattcactttccttcaattgtcagactttgaagaaggtgtgaaagcagaagacttcgtagacagcttagtggctgcttaccaagaagtttttgcaaaattggctgaacttggtgcaactcgcatccaattggatgaagcggctcttgtaaaagacttgacagctgaagaaaaagctctcttcttgaacctttacaataaacttttggctgacaaaaaaggtcttgaagtcttgcttcaaacttacttcggagatgttcgtgacgtatacgctgaccttgtaaacttgccagtagatgctatcggtcttgatttcgttgaaggtaagaaaactcttgaattggttaaaggtggtttcccagctgataagactctttatgcaggtattgtcaatggtaaaaacatctggcgtaataactacgaaaagagcttggctgttcttgaacaaatcccagctgaaaacattgtcttgacaagctcatgctcacttcttcatgtgccatttacaacagctaatgaagaatttgaaccagctatcttgaaccactttgcctttgcagttgaaaaattagatgagatccgtgatttggatgctatccgcaatggtcaaggtgaagaagcacttgcagccaacaaagaactctttgcgactgagcgtgttggtgaaaatgcggaacttcgtgcgcgtatcgctggcttgacagacgcagactacactcgtttgccagcctttgcagaacgtgaagctatccaagaagaagctttcaaacttccagctcttccaacaacaactatcggttcattccctcaaacaaaagaagttcgtgctaaacgtttggcttaccgtaaaggtgaattgtctcaagaagagtatgacgctttccttgctgaaacaattgacgaatggatcaaatggcaagaagatatcgactttgatgtccttgttcacggtgaatttgagcgtaatgacatggttgagtacttcggtcaaaacttgtcaggttacctcttctctaaaaatggttgggtacaatcatacggtatgcgcggggtgaaaccaccaatcatctggggtgatgtaactcgtcttaaccctatcactgttaaatggtctagctatgcacaaagccgtacaaacaaacctgttaaaggtatgttgactggaccagtaactattctcaactggtcattcccacgtgaagacatctctatcaaggattctactcttcaaatcgctcttgctatcaaggatgaagtgcttgaccttgaagctgctggtgtgaaaatcatccaaatcgatgaggctgctcttcgtgagaaattgccgctccgtcgtagcgactggtacgaagactaccttgactgggcaattcctgccttccgcttggtacactcaacagtagcgccagacacacaaatccacactcacatgtgttactcagaatttacagatatcatcccagctatcgacaacatggatgcagatgttatttcctttgaagctagccgttcaaaccttgaaatcttggacgaactcaaagcgaaaaacttccaaacagaagtgggacctggggtttacgatatccactcacctcgtgtgccaaatgaaggcgaaatcgacaatacaatcgaagccatccttgctaaagtgccgagcaagaaagtttggatcaaccctgactgtggtttgaaaacacgtggtattccagaaacaaaagaaagcttgattcgccttgttgaagcagctaaagctgcgcgtgagaaattgtaagataaggatttctctagaagcgctgtttggtcaatctgcctgtttcacttggattctaggaatccagctaacgaaaaaaatcaactagaaaaggataatgactatgtcacgccaaacaccgtcactctcatttgaagtgttccctccaaacccagccgtgggtaatgataaaattatttctgctcttcaagatatgcaggagttggctccccactttatcagtgtgactgccagcaataataaatttaatatcaaggaaacgacggtccgtttggccgactttatccaaaatgacttggcgattccgactattgctcacttgccagccatctatttgaccaaggacaaggttgctgaaaccattgctgatttggacaaggttggagtgcagaaaattttggctcttcgtggggatattattccagatgtggaaccacaaaaggatttccgctacgcaactgacttgatcgagttcatcaaggaacaagcccctcactttgatattgttggtgcttgttatccagaaggtcatccagattcaccaaatcagatttcagatattcaaaatcttaagaagaaagtggatgcaggctgttcgagccttgtaactcagcttttctttgataatgagcgcttctatgatttccaagacaagtgcatcttggctgggattgatgttcccattcatgcagggattatgccaattctgaatcgaaatcaggctctccgcctcttgaagacttgtgagaatatccatcttccacgcaaatttaaagccatcttagacaagtatgagcatgaccctgagtcgctcagagcagcaggacttgcctatgcagtggaccaaatcgtggacttggtaactcaggatgttgccggtgtgcatctctacactatgaacaatgctgaaacagcaaaatatatccaccaagcaacccatgccttgtttaatcaccagtctctaggataataaaaagcaaaccattcttctcaggtgaggggaatggttcctttttaatggtaaaggccgcactttttaagaaaaatatgataaaatagactctgtacgtacttgatacaaagatgagggtattaaataatagaatgcatttaaactgcaaggtttagcgatatgagcgagtcaaatcgatatcatttgacgagagagttagtaaagcatttagctaattgcctgatagcgattagcgtgaaaggtttagatgctttagtctcaaacctttctgatgatttgtatcttgagtaattgaacccgggctaaatccctagtgaaaaagatagatttcctggtgtacatggtacactgcgtcaatcgaatgctatcttgtgtaattgaacccggccgaaaagctgtgtaaaaaagataaactgtcttgtcttcatcgaagacttcgtcagtttcctatttttactttgcttttgacgtccttggtatcttgatctttgtaggcaaggcgtataatttcatcaatccaaaggggattaaaatgacaaaacaagtgtttcaaacgacttttgcgggtcgtgagttaattgtagagactggtcaggttgctaagcaagcaaatggctctgttgttgtacgttatggtgagtcaactgtcttgactgctgccgttatgtctaagaagatggcaactggggatttcttcccacttcaagtcaactatgaagaaaaaatgtatgcggctgggaagtttcctggtggctttatgaaacgtgaagggcgtccttcaacggatgcgacattgacagcgcgtttgattgaccgtccaatccgtcctatgtttgcggaaggtttccgtaatgaagtacaagtcatcaacacagttctttcttatgatgaaaatgcctcagcaccaatggcagctatgtttggttcatccttggcgctttctatttcagatattccatttgacggaccaattgctggggtacaagtgggatatgtagatggccaaatcatcatcaaccctacgcaagaacaagcagagcaatcgctccttgaattgacagtagctggtaccaaacacgccatcaacatggtagagtctggtgctaaagaattgtcagaagaaatcatgttggaagctctccttaaagggcacgaagcagtcaaagaattgattgccttccaagaagaaatcgttgcagcagttggtaaggaaaaagcagaagtagaattgcttcatgtggacgctgaattgcaagctgaaatcatcgcagcctacaacagcgacctccaaaaagcggttcaagttgaagaaaaattggctcgtgaagctgcaactcaagcagttaaggaccaagttactgttgtgtatgaagaaaaatatgcagaccacgaagaatttgatcgtatcatgcgtgatgtggctgaaatcttggaacaaatggaacacgcagaagtgcgtcgtttgatcacagaagacaaggtacgtcctgacggtcgtaaggttgatgaaatccgtcctttggatgcggttgttgacttccttcctcgtgtgcacggttcaggtctcttcactcgtggacaaactcaggctctttcagtcttgaccttggctccgatgggtgaaactcaaatcattgatggtttggatccagagtacaagaaacgctttatgcaccactataacttcccacaatactctgttggggaaactggtcgttacggtgcgccaggtcgtcgtgaaatcggtcacggtgctcttggtgagcgtgcacttgctcaagtcttgccaagtttggaagaattcccatatgctatccgcttggtagctgaggtcttggaatcaaatggttcttcatctcaagcttctatctgtgcgggaactcttgcccttatggctggtggtgtgccaatcaaggcgccagtagcagggattgccatgggtctcatctcagatggaaacaactatacagtcttgacagatatccaaggtttggaagaccactttggagatatggactttaaggttgcaggtactcgtgacgggattacagcccttcaaatggatatcaagattcaaggaatcactgcagaaatcttgactgaagcacttgctcaagccaagaaagcgcgttttgaaatccttgatgtgattgaagcaaccattccagaagttcgtccagaattggctccaactgctccgaaaattgataccatcaagattgatgtggacaagattaagattgtcatcggtaagggtggagaaaccatcgacaagattatcgccgaaacaggcgttaagattgatatcgacgaagaaggaaatgtgtctatttactctagcgaccaagatgctattaaccgtgccaaagaaatcattgctggtttagttcgtgaagccaaagtggacgaagtttaccgtgctaaggttgttcgtatcgagaaatttggtgcctttgtcaatctctttgataagacagatgcccttgttcatatctctgagatggcttggacgcgtaccaataatgtcgaagacttggtagcaatcggtgatgaagttgatgttaagattatcaagattgatgaaaaaggacgtgtggatgcttctatgaaagcccttcttcctcgtcctccaaaacctgaacgtgatgaaaaaggcgaaaagtctgagagacctcaccgcccacgtcataacaaggaccacaaacctaagaaagaatttacagaaacaccaaaagattcagaataagaaaaggagaaatgtatgggatggtggcgcgaaaccattgatatcgtaaaagaaaatgatccagcggcccgcaccactttggaggttttgctgacttatccaggtgtcaaggccttggcggcccaccgtctctcgcattttctctggaagcatggcttcaaactcctggctcgtatgcacagtcagttttggcgcttttggactcagattgagattcatccaggcgcacagattgattcaggtgtctttatcgaccacggctctggtctggtgattggggaaacagcgatcgttgaaaaaggtgttctcctttatcacggagtgactcttggtgggactggtaaggatgttggcaaacgccatccgaccgttcgaaagggagcactcatatcagcccatgcccaagttatcggaccagtagaaatcggtgaaaatgccaaggtcggtgctgcagcagttgttgtagcagacgtacctagtgatgtgacggttgtcggtattcctgctaagattgtccgtgtacatggtaaaaaggatgagccggtcattcacgaagtcgaagaaaaacgagagtactacgtcaataaactcgagcaggctaaagaagccagtcacagatcgtctgggttgtagaggatacctatatgattcaagcaagaaacaagttaagccaagaggagatatctgaggcgaaaaaactaattaactgttgccaaaactatgacggtacctatcgtgatccctatctatctaacatgcttaattttgacccaaacatgcccgcctttttcctttattatgaaaaaggcgaacttgttggtttattaactgtctatgcagatgatcaagatgtggaagtgacgatactggttcatccagctcatcgccgtcaggggattgcgcgtgcattacttactagttttgagaaagaaacggcttctttccctattcgttcagttacttttcagacagagcgtgtttttctagaccgccatcctgattttgttagcaactgggaattggtagaggatgaagagacagaaacttggttaggtaaggatagaaaaccttatccgttagcaactgtttccaatcttgaagttttgttagcagatagttcgtatcaggatcaaattagtcagttaaaatttcaggcattttcagaggaacatgagtctagagagattgtggatagatatgtcgctgaagctctgaaggatccagaaagtcgcttatatattttgttaaaagacggtcaggttattggaacttgcacggtagatttatcgactaatacgaattacttctacgggttagcaatatctgaacctgaacgtgggaaaggctatggaagctacttagcaaaatcccttgtcaaccaactaattgagcaaaatgacaaggaatttcagattgcagtagaggacagcaatgtaggtgccaagcgcttgtatgaaaaaattggctttgtcaaacagacccaggtggtttatctgaatgagaaaggagcaagggattccgaagtgtagagagattcggactgaaattcaattgaactcttagtgatgaaactaattgttcttggattttagctttcctaactatgatttatgattaaaatctatgacactatgtctcgtgatttgcgagaatttgtcccgattgaggacggcaaggtcaagatgtatgtttgtgggccaaccgtgtataactatatccacgtagggaatgcccgttcgacggtagcttttgatacgattcgacgttactttgagtatcgtgggtacgaagttgcctatatttctaatttcacggatgtggatgataagattatcaaccgtgccaaggaagaaggcatcacgcctcaggaggttgcggacaagtacatcgctgcctttcgtgaggatgtgacagccttgggcgtcaaacctgcgacccgccatccgcgtgtggtggagtttatggctgacatcatccgctttgtggaagatttgattgaaaaaggctttgcctacgagagtcaaggagatgtctatttccgtgtggaaaaatctcacaactatgccaaattggctaataaaaccttggaagatttggagctgggtgcttcaggtcgtaccgatgaagaaacagctcgtaaggaaaatcctgtagactttgccctctggaaatctgccaaatcaggcgagatttcttgggacagtccttggggacctggtcgtccgggctggcacatcgagtgttcagtcatgtcgacagagattttgggcgacaccattgatattcacggtggtggagctgacctagagtttcctcaccataccaatgaaattgcccagtcagaagccaaaacaggcaagacctttgccaactattggatgcacaatggctttgtcaatatcgacaatgtcaagatgtccaaatccttgggcaactttatcacagtgcacgatgccctcaaaaaccttgatggccaagtacttcgtttcttctttgcgacacaacattaccgtaagcctatcaactttacggaaaaggcagtgcgagacgctgagaccaatctcaagtatttgaaaaacacctatgagcaaccatttactggaactgtaaatgctcaagagttgcaagcttttaaagataagtttgtagcagcaatggatgaagattttaacgcggcaaatggaatcacagtagtctttgaaatggccaagtggatcaattctggcaactatgatgcaagtgttaaggaagctcttgcagccatgttagaagtctttgggattgtctttgttgaggaagttttggatgcagagattgaagacttgatccaaaaacgccaagaagcgcgtgccaatcgtgactttgcgacagcggaccatatccgtgaccaattggctgctcaagggattaagctcctagacaccaaagatggagtgaggtggacacgtgattgatgtcaatctcattaacgggattgcgttagcttttgagggggacgcggtgtattctatgtatattcgccgtcacctcatcctcaaaggtatgaccaagcccaataaactccaccaagaagcgaccaagtatgtctcagccaaggctcaggctcgcctgatttcccttatgttagaggagcaagtcctgacggaaaaagaagaagaaatctataaacgtggtcgcaataccaatagtcacaccaaggctaaaaatgctgatgtggtaacttaccgtatgtccacaggttttgaagcagtcatgggctatctccatatgactgaaaatctggaacgtcttgagagcttgatttcgtggtgcatccaaaaagtggagggctaggacatgatagcaaaagaactacaagactggtttcctgaagctcagatttcagaccaaccagtagagaaagagggctatctcactctccctttagcttctcagcagtggattttgctggaggaagctgggctcagcgagcgtgaaaagcagttggttgcccttttgacccagcaggagcaggctcgttcgctcaatccttggtattcttatctgattgagggtaagggacaggcaccacaagcttttaaaaagattcagctggtttactgtcatctttcctattttcagcaggaaaatctagcttcttggctggatatgatgcggaccctttttcctaactgtcagacggtgcttcaggttggggctcaggattatgttttcgtacttcaacaagataaatacacctctgtacgagctattttaagtgatacgattgaagcggttgagtatgactttggacttcgtctgtcaatcatgttgggccaggtttggtctcagacaggccatcaagccctatcagacttgattaaagcagagcgcgatttgtttaagacttggtggcgtcagggtcaccaaggtgttcacaccttttcacaactctatctttggagtatgggggaaagaattgtggacctgagagtcattaaagaatgtctacaccagatgattttggatcaagaccagattcaggaaatcattctctctctttgggaaaatagtgctgttctcactaaaacagcccagcaactctatctgcaccgcaattctctccaatacaagattgataaatgggaagagttgacagggcttcagttgaaagaattgactgacttgaccctgtgttatcaattgattttaccagatattctctaaagttttgtgcaagttgcacagaacttttttatttttttggtcaccttgccatagaaatgtaaagcgttttcatctataataaaactatcaaaagacaaaaggagttcacctcatggtagaattgaatcttaaaaacatttacaaaaaatatccaaacagcgaacactattcagttgaagacttcaacttggacatcaaagacaaagaatttatcgttttcgtaggtccttcaggatgtggtaaatcaacaactcttcgtatgattgctggtcttgaagacatcacagaaggtactgcatctatcgatggcgtggttgtcaacgacgtagctccaaaagaccgtgacatcgccatggtattccaaaactacgctctttacccacacatgactgtttatgacaacatggctttcggtttaaaattgcgtaaatacagcaaggaagacatcgataaacgtgtgcaagaagcagctgcaatcctcggtttgaaagaattcttggatcgtaaaccagctgacctttcaggtggtcaacgtcaacgtgttgccatgggtcgtgccatcgtccgtgatgcaaaagtattcttgatggacgaacctttgtcaaacttggatgcaaaacttcgtgtatctatgcgtgctgaaatcgctaaaatccaccgtcgtatcggagctacaactatctacgtaactcacgaccaaacagaagcgatgacacttgcagaccgtatcgttatcatgtcagcaactaaaaaccctgctggtacaggtactatcggacgtgtagaacaaatcggtacacctcaagaagtttacaaaaacccagttaacaaattcgtagcaggattcatcggaagcccagctatgaacttcatcaacgtgaaattggttggtagcgaaattgtttctgacggtttccgtttgaaagttccagaaggagcattgaaagttcttcgtgacaaaggctacgaaggtaaagaattgatcttcggtatccgtccagaagacgtgaatgcagaacctgctttccttgaaacattcccagaatcagttgtcaaagctactatctctgtatcagaattgcttggttcagaatctcacctttactgccaagttggtaaagatgaatttgttgccaaagttgatgctcgtgactacttgcaaacaggtgcaacagttgaacttggatttgacttgaacaaagcacacttcttcgacgtagaaactgaaaaaacagtctactaagcaaatgaaatgtcaaaacactgctagaaatctggcagtgtttttttgagattgcgtagaaaaaactcctgggaaattccaggagagtatgagtaattatttgaacttgaatccttcgtaaataagctctgtttttggactttctttcttaatctgtttggcaagtgacttcatcatagaaagaggaccacacatatagacgcttgcatgatcgggcactttttcttgatcaaaattaagatagccgtctttcctactgtctactagatggagttcaaaattaggatttttctgagcatagtcacggagcaaatctaggtagactgcattttcctctccatggaagctatagtagaagtgaacctgtttatctaaaataggatgttcacggatgtaagagatgaagggggtgattccaatacctccagcaatccaaacctgattttctcgtccttcttttatgatcatgtgtccgtaagctctgtctacgcttactttgctgccgacttgaagattgtcatagatattcttggtatggtcgcctgaatttttaacagtaaagtaaagagtttgaccatgacctcctgagatagaaaagggatgcggagcgctttcaaagccttcttggaaaatctttagaaaggcaaattgtcctgattgatagttgaaaggtctgctaagatggatttgaatttctctagtatcatgatttaagtgtttgagattggtaattttccctagataggggaagccaatcttttgatatagaaaaatgatataaaaaccagctagtaagcctaaaagggcatagctaccaacaagaaaacttagaagattaaatgtaaggagacgattgcccatcatcatgtagacgtgaaggagtccgaaaatataagctaggtaaactagacggtgaatccatcgccaagcttcgtattggatgtatttgcctaaataggcgacaaggatgatactgacaaagatatagatggcaagatttccaaactgagtagctaatcgagagccccacaaaccgcccatactaaagttatgaaagatgagtaggatgatggagagaaaggctgtgaatttgtggacggtgtagaccttctccaaaccgtgaaaccagttttctattagagggagacgagtggcgaggataaaggtcagagataggcttgttaaagctagtcctggaatcatgaattggggagaagtgttcatccaagtcaaaatagtcaagataaaactagctatgataaagagtagtcctttgattgatttcatagaaaattccattttattaagattttgatttgttgtaaataaatttgttacattttatcatagaaaaagtatggtgtcaaattgaggtctataaatgtttactatcatcaaaaaactctccaattgaactggagagtggctgtttatactcaatgaaaatcaaagagcaaactaggaagctagacgcaggctgtacttgagtacggcaaggtgaagctgacgtggtttgaatttgattttcgaagagtattattctgcagcttgttgccaacgtttggccagcatatgagataggctcgaaattgctaggttaaagctgaagtagatgagggcaatcaggatatacagactgaagacttgctctggttcgaaataacggcccatgagaatttggctagctccaaagagttcttgtagggcgataacagagtagaggaggctggtatccttaatcacggttacaaactgagaaatgatggctggcagcattttacgaatggcttgtgggagaatgatgtggtagaggatttgggctgaggtaaatccttgcgacattcctgcttcgtactgccccttgtctacggcattgagaccgcctcggataatctcagctagggccgctgatgtaaagagggtaaaggcagtgattcctgctggtgtggatttcatcttgaacactaaaaagatagtgaaaatccagaggaggttgggaacgttacgcacaaactcgatgtaaatgctggagatgatgcgcaagataggatttttgccatttctcatgacagctagcaccgtaccgataagggtagagaggacgatggcaatcagagaaatgtagagggtcaagcaaaatcctttaaagataaagactaggttatctggggtcaaaacttctaaaatggattccatagtaacctcctaaagtgaataggcttttttgttggcttgctccatcttgcgaccaaactgggcaacagggaagcagagagaaaagtagagaagggcagcgcctaaaaaggctggaatgtagtttccattgagagctgaccaagacttggtcacaaacatcaagtccactccagagatgatagcgacggtggaggtgtttttgatgaggttgacgatttggttggtcaaaggagggagaatgatacgaaaggcctgaggcaagataatcaaacgcatagcactgatataggtaaaaccttgcgacaaggcggcctccatctgaccgctaggaatagactgaattcctgagcgaatcacctcagcgatataggcgccgtgataaagtccgacgcagagaacagctgtccaataaatcggaatcatgatgatatggtcactgataagaggtaggccataaaaaacgataacaaactgcaccaagaggggagtattttggtaaaattcgacaaagatgcgagccaaaattctcaatatcggacgtttactggttgacatggctccgaagaagatgcccaaaaccatggctaggataaaggatccaatcgctagggcaagggtgaagaggaaaccattgaaaaattgtccaaaatcctgaaaataggctgtccaagatgataaatctgtcatggggtgtcctccttaatctgcggtatgactagatggtttgagcttgtaacggtcatagagtttctgcaaactgccatccttgctccatttagtaaccaagttatcgagatagtcgttgagttcggtatttgatttcttggtaacgataccgtagtcagatggcttgaaactatcatctagtagtactgtgcgtttgctgatgtagccagacaaaatcgagcggtcaacggaaaaggcatcaatacggtgagcgtgtagggaagtgatcaattctgggtaggaaccaagttcgacgaatttaaacttcaggcctttctttttacccagttcagtaatcaggcgttgggtgatggaaccttgggcaacaccgatggtttttccgtttaggtcctcaatgcttttgattttggcagatttattgaccaaaaagccagatgcgtccgtgtagtagggactggtaaagttgtagagttttttgcgttcgtctgtgatggtaaaggttgcgatatccatatcgacctgttcattgtctagaagtggtccacgagtttgtgcggtaacaggcacatagcgaaccttgaccttgagttcatctgctaccatcttggccaagtctgtttcgataccagaataggtccctgtcttaggatccttgtagccgaaattgggaacgtcttgttttacaccgacaaccagctcgcctctcttttgaatgtctgcgacactggtatcagcctgaactggttttgcagcagcaaggcccaaaaggctaatcaataatgcggataaaaagaatttctttttcataggcgcctccttatttgactttgtcactttcgtggttgatgattttgctgaggaattgttgggcacgaggttcacttggattgtcgaaaaagtcatcaacatctgtcgtatccaccaaaacctctccatcagccataaagatgatgcggtccgcaacttcacgggcgaagcccatttcatgggtcacgacaatcatattcataccatcgtgggctaatttttgcataactgccagaacatcgccgatggtttcagggtcaagagcagatgttggctcatcaaagaggaggagttcaggatgcatagcgagtccacgtgcgatggcaatccgttgtttttgtccaccagatagcatggctggataagaatctttcttgtcccacatatttacaaattccagatatttttgggctgttttttcagcttctattttatcaattcctagaacttttatgggagctagtgttatattttctaacaccgttctgtgtggatagaggttgaaatgctggaaaaccataccgacttccttgcgaagcggtactaaatctttctggctggcaccagcaacttggtgaccatttactagaaggcttcctttatcaacagcctccaaaccattgatggtgcggataagagtggattttccagaaccagaagggcctaggaggacaacgacttgccctttttcaaaacggagattgatgtcgcggagtgcgtggtagtctccgtaatatttttcgacgtgttcaaattctactaaagccataaggaatctcctttgtgttagattttataacatgattctacaccaaaagatttgtcttgtcaaatcatatctgaaaaaattcactaaaattttataaaaaagcaatctggatagagaaaaagcctaaatcgtgttataatgaagcaagagaattcttagaaagagtggatgtctttttgataacacctacttatgaatggcagtttgccccgcaggtagaagatgcggattttacaaagatagccaagaaggctggactgggtcctgaggtggctcggttattatttgagagggggattcaggaccaagaaagtctgaagaagtttttagagccttctttagaggacttgcatgacccttatctactccatgatatggacaaggcagtggaacggattcgtcaggccattgaagaaggggaaaatattctcgtctatggagactacgatgcggatggtatgacttcggcttctattgtgaaggaaagtttggaacagcttggtgccgagtgccgggtttatctgcccaatcgttttaccgacggttatggacctaatgccagtgtttacaaatactttatcgagcaagaaggaatttccttgattgtgacggtggataatggggttgcgggtcatgaggccattgacctggcccagtctatgggagtggatgtcattgtgactgaccaccattccatgcctgaaaccttaccagatgcctatgctattgtccatcctgaacatccggatgcgaactatcctttcaaatatttggctggttgtggagttgctttcaagctggcttgtgcccttttagaagaagtacaagtggaattgcttgatttggtcgctattggtaccattgctgatatggtgagtttgacggatgaaaaccgtatcttggttcagtatggtctggagatgttgggacatacccagcgcattggtctgcaagaaatgctggacatggctgggattgctgccaacgaagtaacagaagaaacggttggtttccagattgcccctcgtttgaatgccttgggccgtttggatgatcccaatcctgccattgatttgctgactggctttgatgatgaggaagcacatgagattgctctcatgattcatcagaaaaacgaagagcgcaaggaaatcgtccagtctatctatgaagaagctaagaccatggtggaccctgagaagaaggtccaagtcttggctaaggaaggctggaatcctggggttctgggtatcgtcgctggtcgtttgttggaagaactagggcagacagtcattgttctcaatatagaggacggtcgtgccaagggtagtgctcgtagtgtggaagcggtcgatatttttgaagccctagatccccatcgcgacctctttatcgcatttggcggtcatgctggtgcagcaggaatgacgctggaagttgagaaactctcagatttatctcaggttttggaagattatgtccgtgaaaaaggagcggatgctgctggcaagaacaagttaaatctagatgaagaattggatttggaagcacttagcttggaaacagtcaaaagttttgaacgtttggcaccttttggcatggacaatcagaaacctgtcttttatataaaggattttcaggtcgaaagtgcccgtaccatgggggcaggcaatgcccatctcaaactgaaaatttctaagggtgaggctagttttgaagtggtggcctttggccaaggcagatgggcgacagagttttctcaaaccaagaatctagagctggcagtcaaattgtctgtcaaccaatggaatgggcaaactgccctccagttgatgatggtggatgcgcgtgtggagggtgttcaactttttaacatccgtgggaagaatgcagttttgccagaaggggttccagtcttggattttgctggagaatttccgaatctagtaaatagtgaagctattgtcgtgaaaaccattcctgaggatattactcagctgaagaccatttttcaggaacaaaatttctctgctgtctatttcaaaaatgatattgacaaggcctactatctgacagggtatgggactagagagcagttttgccaaattgtacaagaccatctaccagtttccagagtttgatattcgctacaagctgaaagatttggcagcttatcttaatattcagcaaatcttgctggtcaaaatgattcaaatatttgaagaattaggttttgtggtaatcaaagatggggttatgacagtcaataaagaagcgccaaagcgggaaatcggagaaagtcagatttaccaaaatctcaaacaaaccgtcaaagaccaagaaatgatggcgctgggtaccgtgcaagcaatttatgactttttaatggaaaaagagtagatcataggaaagagttgggaaaccagctcttttttgaaaacaaatcttcattttgaaaatcatcaaaaaaatggtataatggtaggaaaagattcggctaaaagtaatgcttttagaataaaagggcaagcaaccctataatcaagataaactaagctttcggaggaaaaatgagtaatatcagtttaacaacacttggtggtgtacgtgaaaatgggaaaaatatgtatatcgctgaaatcgatgggtctattttcgttttggatgcaggtctaaaataccctgaaaatgaacaactaggggtggacgtagtcattcctaatatggactacctttttgaaaatagcgaccgtattgctggggttttcttgacccacgggcatgcggatgccattggtgctctgccttatctcttagctgaagccaaggtacctgtatttggctctgagttaaccattgagttggccaaactttttgtcaaaggaaatgacacagttaagaaattcaatgatttccatgtcattgatgaggatacggagatagattttggagggactgtggtgtccttcttccgtacgacccactctatcccagaaagtttgggtgttgtcttgaagacagctgaaggtagtatcgtttatacaggtgacttcaaatttgaccagacagctagtgaatcttatgccacagacttcgctcgtttggcagaaatcggtcgtgatggagttctagctcttcttagcgattcagccaatgcggacagtaatatccaagtggctagcgaaagtgaagttggggacgagattactcaaaccatttcggactgggatggtcgtatcattgttgcagcagtagctagcaacctctctcgtatccagcaggtgtttgatgctgcggatgcaacaggccgtcgtgtggtcttgacaggatttgatattgaaaatatcgtccgtactgctattcgcctcaagaaattgtctctagctaacgaaagtcttttgattaaaccaaaagatatgtctcgctttgaagaccatgagttgattattcttgagacaggtcgtatgggtgagcctatcaacggtcttcgcaaaatgtcgattggtcgccaccgttatgtggaaatcaaggacggtgacttggtctatatcgtaaccactccgtctatcgctaaagaagcagttatggcgcgtgtggaaaacatgatttatcaagctggcggggttgttaaactgatcacccaaagtttgcgtgtgtcaggtcacggaaatgcgcgtgacttgcagttgatgatcaacctcttgcaacccaagtatctcttcccaattcaaggggaatatcgtgagttagatgctcatgctaaggctgctatggcagttggaatgttgccagaacgcatttttatccctaaaaagggaaccagcatggcttatgagaatggagactttgtcccagctggagcggtttcggcaggggatgtcttgattgacgggaatgctattggtgatgttggtaatgtggttcttcgtgaccgtaaggtcttgtcagaagatggaattttcatcgtcgcaatcaccgttaaccgtcgtgagaagaaaattgtggccaaggctcgtgttcacacgcgtggatttgtttatctcaagaagagccgtgatattctccgtgaaagttcagaattgattaatcagacggtagaagactatcttcaaggagatgactttgactgggcagatcttaaagggaaggttcgtgataatctgaccaagtatctctttgaccagactaagcgtcgtccagctattttaccagtagtcatggaagcaaaataagcgatgaaataaacggagagaaagtcgaatttcggctttttcttatagaaaaatagaggaaaaattatggcagtaatgaaaatcgagtattactcacaagttttggatatggagtggggagtgaatgtcctctatcctgatgctaatcgagtggaagaaccagattgtaaagacattccagtcttgtacctcttgcacgggatgtctggtaatcataatagttggctcaagcggaccaacgtagaacgcttactccgaggaaccaatctcatcgttgttatgcccaataccagcaacggttggtataccgatacccaatatggttttgactattacacagctctagcagaggaattgccacaggttctgaaacgcttcttccctaatatgactagcaagcgtgaaaaaacctttatcgctggcctctctatgggaggctatggctgtttcaaattggctcttgctacaaatcgtttttctcatgcagctagcttttcaggtgcgcttagttttcaagatttttctcctgaaagccaagatttgggaacaccagcttactggagaggtgtttttggggagattaaagattggacaactagtccttattctctagaaagtctggctaaaaaatcggataaaaagaccaaactttgggcttggtgtggcgagcaggatttcttgtacgaagccaataatctcgcagtgaaaaatctcaataaactgggatttgatgtgacctatagccatagtgctggaactcacgaatggtactactgggaaaaacaattggaacggttcttagcaaccctaccaatcgatttcaaattagaagagagattaagctagtttagtttgtattactctttcaataaccatgtcttctatggaatagaaactaaaatatgtttttactagactttctaaacaaaaatagtagaatagtagttaaattctattattgttggaaagagagtaagagatgtatcgttatcaaattggcattcccacattagaatatgatcagtttgttaaagaacatgaattagtcaatgtattacaaagtagtgcttgggaagaggttaagtctgattggcaacatgaaaagtttggcgcctaccgaggagataaattactggctacagctagtattttgattaaaactcttcctctaggctatagaatgttttatatcccaagaggtcctgtattagattataaggatgctgaactcttgaactttgttcttcaatccattaagtcctatgctcgaagcaagagagcgatttttgtgatttttgacccaagtatttgcctatcgcaaagttcaatcaagcatgaaaaaatagaatatcctgaaaatatggctattattgaaaatttgcaaagaatgggagtaaggtggtcaggaaagaccgatggaatgggagataccattcagcctcgtattcaggcaaaagtatacaaggaaaattttacagaagataaactttgcaagtcaacaaaacaagctattcgatccgctcgaaataagggtgtagagattcagattggtagagatgaattgttagaatctttctcgtttttgatgaaaaaaactgagaagcgaaaagatatccatttgaggaatgaagcctattataaaaaattgttagataattttaaggacaaggcctacattacgctggctactctggatatcgctaagcgtttacgagaattagaagaacagttagcgaaaaacttagcgttggaagaagcgtttactgagtcgactcgaacttcaaaagtagaagcccagaagaaggaaaaagagcgtttggtagaagaaagagatttcttgcagagatatctgaatgaagaaaaatcaaacattcctttagcagctactttgagtttggaatttggtaatacctctgttaatctatatgctggtatggatgatgcttttaaacgttataatgcaccaattttagcttggtatgaaacagctcgctatgcttttgagcgaggtatggtgtggcaaaatttaggtggtgttgaaaactctctcaatggtggactttaccattttaaggaaaaatttaatccaacgattgaagaatacttgggtgagtttacaatgcccacccatcctctttattctctgttaagaatcgctcttgattttcgcaaggcattaagaacaaaacatcatagaaggtaagtacatggcattaattacactcacaaaagaagaatttcaagcttattctgatcaggtctcttctcgttcttttatgcaatctgtccagatgggggacttgttagaaaaaagaggggctcgaattgtttatcttgcattgaaacaagaaggagaaattcaagttgcagctctggtttatagcttgcccatgctgggtggcctacatatggagatcaattcggggccgatttatacccaacaagatgctctcccagttttttatgcggagttaaaagaatatgccaagcaaaatggtgtattagagttgcttgtaaaaccttatgaaacttatcaaacttttgatggtgaaggtaatccaatagatgctgagaaaaaaagtattattcaaggtttgactgatttaggttatcaatttgatggtttaaaaacaggttacccaggtggagaaccggattggttatattgtaaagatttgaatgagctaactgaaaagaccttgcttaacagttttagtaaaaaggggaaagctttggtgaaaaaggctgatacatttggtattcagttgaaaaaattaaatcgtgaagaactttcaatttttaagaatataacaaaagaaacctctgaacgtagagaatatagtgataaaagtttagaatattatgagcacttttatgattcatttggagaacaagcggagtttgtaattgctaatctaaatttaggagaatatatacaaaatttaatacataagcaaaaagaattatctgaaaaaatagctacctcactactcttattagaacaatatccagattctgcacaaaagaaaaaagaacacaaagaattggctaggcagtatgaaagctttgaagttcgaaaagcagaagcacgagagttgattgaaaaatatggagagaaagatcttgtcttagcaggtagtttatttatttatatgcctcaagaaacgacctatctttttagtggttcctatactgagtttaataaattttatgcaccagctttgcttcagaaatatgttatgttggaaagcataaaacgtgggatccctaaatacaacttcctagggattcaagggatttttgatggtagtgatggtgttttgcgttttaaacaaaattttaatggctatattgtacgcaaagcgggtactttccgttaccatccatcacctttaaaatacaaagctattcagttattcaaaaaaatattaggacgttaagatgaaaaagccagtatttagctttctttcagcttgatttagtaaaatagtctttatttgctagaaaggtggagagacatgcgctggattttttgtttgataggggctttcttttcttttgtgtggcgtttgttttggcgcctggtttggatagttgtgctcttatgtgcgtttgctttcggacttctctgctatctgaacggggattttcaaggagcgctaaagcaggcagaacggtcagtcaagattggtcaacaaagtatcgaccgatgggaaaaaacagggcaactgcctaagttgaaccagacagatagccaccagcattctgaaggaaggtggccacaggcctctgctcgtatttacttggatccccagatggattcacgctttcaagaagcttatttagaagcgattcagaattggaatcaaacgggtgcttttaactttgaaattgtcaccgagtccagcaaggcagatatcttggctacggagatgaatgacggaggtactcctgtggcaggagaggcggaaagtcagaccaatctcttaacaggacaattcttgtctgtaacggtgcgtctgaatcattattatctgtccaatcctgactatggctattcctatgagcgcgttgtccatacggcagaacatgagttgggtcatgcgattggcttggaccatacagatgagaagtctgtcatgcaacctgcgggttccttttatggtatccaggaagaggatgttgcaaaccttcgaaaaatatatgagactagtgagtagggaacaatctttccctacttttttgctataatggaattatgaacaacttgattaaatcaaaactagagctcttgccgaccagccctggttgttacattcacaaggataaaaacggtaccattatctatgtaggaaaggctaaaaatctgcgtaaccgcgtgcggtcctattttcgtggaagtcatgataccaagacggaagctctggtgtctgaaattgtagattttgaatttattgttacggagtctaatattgaggcacttctcctagaaattaatctgatcaaggaaaataagcctaaatacaatatcatgctcaaggatgataagtcttatcctttcatcaaaatcactaatgagcgctatcctcgtttaattatcacccgtcaggtcaagaaggacggcggtctctactttggaccttatccagatgtgggggcagccaatgaaatcaagcggctgctggatcgaattttcccttttagaaagtgtaccaatccaccgtataaggtctgtttttactaccatatcggccaatgcatggcccacactatctgtaagaaggatgagtcctacttcaagtctatggctcaggaggtttctgatttcctaaaagggcaggatgacaaaatcattgatgacctcaagggcaaaatggcaacggcagcccagtctatggagtttgaacgtgcggcagaataccgtgacctgattcaggctattggaacgcttcgaaccaagcaacgggtcatggctaaggatctccagaatcgtgatgtctttggctactatgtggacaagggttggatgtgtgtgcaggttttctttgtccgtcagggaaaactcattgaacgtgacgtcaatctattcccctactacaatgatccggatgaggattttctaacctatgtaggacaattctatcaagaaaaatctcatctagttcccaatgaggtgctgattccgcaggatattgacgaagaagctgtcaaggtcttggtggataccaagattctcaaaccccagcgtggagagaaaaagcaactagtcaatttggctataaagaatgctcgagtcagtctagagcagaagttcaatttgttagaaaaatctgtcgaaaagacccaaggagctattgaaaatctaggtcgtttgctccaaattcccaccccagttcgcatcgagtccttcgataactccaacatcatgggaactagtcctgtttcagccatggtggtctttgtcaacggaaaacctagtaagaaggattaccgtaagtataaaatcaagactgtcgtcgggccagacgactatgctagtatgcgagaggtcattcgcaggcgctatggtcgagtacagcgtgacggtttgactcctccagatttgattgtgattgatgggggacaaggtcaagtcaatattgccaagcaagtcattcaagaggagctgggcttggatattcccattgcaggtctgcaaaagaatgataagcaccaaacccatgaattgctctttggagatccgcttgaggtggtggagttatctcgcaattctcaggaatttttcctcctccaacgtatacaagatgaggtccaccgctttgctataactttccatcgccaactgcgctcgaaaaattctttttcatcacaactggatggaattgaagggctgggacctaaacgcaagcagaatctcatgaagcatttcaagtctctaacaaaaatcaaggaagccagtgtggatgagattgtcgatgttggagtacctagagctgttgcagaggctgtgcagaggaagttgaacccgcaggaagcagtggaattagctcaagtggcggaagaaagagtagattaccaaacggaaggaaaccacaatgaaacataaaatcgcaattttatcagatattcatggaaatgcgacggctttagaagcagtgattgcagatgctaaaaatcaaggagtcagtgaatactggcttctgggagatatttttcttcccggtccaggtgcaagtgacttggtagccctgctaaaggaccttcctatcacagccagtgttcgaggcaattgggatgattgtgtccttgaggccttggatggtgaatatggtttggaacatccacaagaaatccagtcaatgcgaatgacccagtttttgatggagcgaatggatcctgcaacgattgtctggttacgaagcttgcctttgctggaaaagaaagaggttgctgggttgcgcttttctatctctcataatttacctgacaaaaattatgggggtgacttgttggttgggaatgatacagaaaaatttgaccaactgctagatgaggaaacggacgtggcagtctatggtcatgtccacaagcagttgcttcgttacggcagtcaagggcaacaaatcatcaatccagggtcgattggcatgccctattttaattgggaggcgttaaaaaatcaccgtgcccagtatgccgtgatagaagttgaagatggggaattggtaaatatcctatttcgtaaagtcgcttatgactatgaagcggagttggagttggccaaattcaaggggcttccttttatcgaaatgtatgaagagctacgacgagaagacaactatcaggggcacaatctgaaactcttagccaatttaatagaaaagcatgggtatgtagaggatgtgaagaatttcttggaggctataaagtcagaatataagatggactagtttctttaagcagctgaaaattaattggaactggatgaggggattcctgatttaaatggttttcttcattcggttgcttatccttgttccagtttgtttctacgaaaaatctctgcaagctctttcaaattatggtagaatggaagcagtagaattagaaaaggaaatcgattatgaaatttcttgaattaaataaaaaacgtcatgcgactaagcatttcactgataagccagttgatcctaaggatgtgcgtacggctatcgaaattgcaaccttggcaccaagtgcccacaacagccagccttggaaatttgtggtggtacgtgagaaaaatgccgaactagcaaaattggcttacggttcaaactatgaacaggtatcatcagcgcctgtaactattgccttgtttacagacacagatttggctaaacgtgctcgtaagattgcccgagttggtggtgctaacaatttctcagaagagcaacttcaatattttatgaagaatttgcctgctgaatttgcccgctacaatgaacaacaagtcagcgactacctagctctcaatgcaggtttggttgctatgaacttggttttggctcttacagaccaaggaatcggatcaaatttgatccttggatttgacaaatcaaaagtcaatgaggttttggaaattgaagaccgtttccgcccagaacttttgattacagtgggttacacagacgaaaaattggaaccaagctaccgcttgccagtagatgaaatcatcgagaaaagataggaagaagaaaaaaatgacagcaattgattttacagcagaagtagaaaaacgcaaagaagccctcttggctgacttgtttagccttttggaaatcaactcagaacgtgatgatagcaaggttgatgctgagcatccatttggacctgggccggtaaaagccttggaaaaattccttgaaatcgcagaccgcgatggctacccaactaaaaatgttgataactacgcaggacattttgagtttggtgatggcgaagaagttctcggaatctttgcccacatggacgtggtgccagctggtagcggttgggacacagacccttacacaccaactatcaaagatggtcgtctctatgcgcgtggggcttcagatgacaagggacctacaacagcttgttactatggtttgaaaatcatcaaagaattgggacttccaacttctaagaaagttcgtttcatcgttggaacagatgaagaatcaggttgggcagacatggactactatttcgagcacgtaggacttgcaaaaccagactttggtttctctccagacgctgaattccctatcatcaatggtgaaaaaggaaatatcacggaatacctccactttgcaggtgaaaatgcgggtgctgcccgtcttcacagctttacaggtggtttgcgtgaaaacatggtaccagaatcagcaacagcagtcgtttcaggtgatttggctgacttgcaagggaaactagatacttttgttgcagaacacaaactcagaggagaaattcaagaagaaaacggtcagtacaaggttaccatcattggtaaatcagcgcatggtgctatgcctgcttcaggtgtcaatggtgcgacttacctagccctcttccttagccagtttgactttgctggtccagccaaagactaccttgacatcgctggtaagattctcttgaatgatcatgagggtgaaagtctcaagattgcccatgtggatgaaaagatgggtgccctttctatgaatgctggcgtcttccgctttgatgaaacaagcgctgataataccattgcccttaatatccgctatccaaaaggaacaagcccagagcaaatcaagtcaatccttgaaaacttgccagttgcttctgttagcctttctgaacacggtcacacgcctcactatgtgccaatggaagatccacttgtccaaaccttgttgaatgtctatgaaaaacaaactggtcttaaaggtcacgagcaagtcatcggtggtggaacctttggtcgtttgctagaacgcggtgttgcctacggtgctatgttcccagactcaattgacaccatgcaccaagctaatgaatttatcgccttggatgatctcttccgagcagcagcaatctatgccgaagctatttacgaattgatcaaataaaacgatagaagtctgagattgtatgcttagacttctttttggagggagagtagatgtctcaaattgaaaaaatcaagcaggctattatggcagatccgcagaatgctacctatacagagcgtggcattgagcctctctttgcagcaccaaagactgctcgcatcaatatcatcggtcaggcaccggggcttaaaacccaagaagcaggactttattggaaagataagagtggtgaccgcctgagagactggctaggtgtggatgaagataccttttacaattcaggatattttgctgttctgcctatggatttctactttccaggacatggcaagtcaggagacttaccaccgagagcagattttgcagaaaaatggcatccacagctcttgcaagaattaccagatatccaattgaccctcttgattggccaatatgcccaagcctactatttacaggagaaagtcagtggcaaagtgacagaacgggtaaaacattaccagaactacttgccaacctattttccattagttcacccctcgcctagaaatcaaatctggatggccaaaaatccttggtttgaggcagaagtggtgccagatttgaaaaaaagaattaaaactattttatagtcaatgaaaatcaaagagcaaactaggaagctagccgcaggctgtacttgagtacggtaaggcgacgctgacgtggtttgaatttgattttcgaagagtattaggagaaaaagaatgaaagaaatttcctttgacgcattttaccagctttaccaaaatgaccaactttctttagtggacgtgagagaagtggatgagtttgaagctcttcatttagaaggtgctcagaatcttcctctgagtcaattagctgatacttatgatcaattggacaaggaccagttacattatgttatttgtaaatctggaatgagatcggcgcgtgcttgccaattcctatcagaacaaggttatgaggttatcaatgtacagggtggcatgttagcctttgaagaactttagacattagaattttctcctacttggcgtggactgggtaggggattttatttttagacaattctcatttttaagaatcttgaaaacattcaatatttacttcgtgaagcttttttcatactcctattcatgatatactaggtcagtattttataaatatgaaggagattttcatggctaaaaaaggtgccctaacaggtttactcctgtttggaatattttttggtgcggggaacttgatttttccgccttctctaggtgcactatctggagaacattttcttcctgccatcgcaggttttgtcttttcaggtgtcggtatcgccgtcttgactcttattattggaacgctaaatcctaaaggatatatctacgagatttcaacaaagatagcgccttggtttgcgactctttacctctcagttctttacttgtcaatcggtccattctttgctatcccacgtacagctacaacagcttacgaagtagggattagcccccttttgtcggatgcaaataaaggtcttggtttgattgtctttacagttctgtattttgcagcagcctatttaatctcgcttaatccatcaaaaatcttagaccgtattggccgtattttaacgccagtctttgcgattttgattgttatcttagttgttttaggagctttcaaatacggtggaacaagtcctcaagctgcttcagctgcttatcaagcttctgcctttgggacaggtttcctagaaggttacaataccttggatgctcttgcctcagttgcctttagtgtaatcgcagttcaaaccttgaaacaacttggcttctcaagtaagaaagaatacatttcgactatttgggttgttggtatcgttgttgcccttgccttcagcgctctttacatcggtttaggtttccttggaaatcatttcccagtaccagctgaagcgatgaagggtggaacacctggtgtttacatcttgtcacaagcgactcaagaaatctttggctcaacagctcaactcttccttgcagctatggttactgtaacctgcttcacaacaacagttggtttgattgtgtctacagctgagttctttaatgagcgcttcccacaaatcagctataaggtttatgctacagcctttaccttgattggatttgctattgctaacttgggtcttgatgcgattatcaagtactcaatccctgtactggttatcttgtacccaatcaccattgccatcgttatgattgtcattgtcaacaaatttgtagctctttcaaaaccaggtatgcagttgacaattgcagtcgttacagctattgccattgcaagcgtattaggaagctcatttaaggttgagtttcttgcaaaccttgtcaacgctcttccttttgccaaggcatcactcccatggttagtacctgccattgtcggaatcttgctctcgttggttctaccaaacaagcaagaaagcgatgtttttgaaatggaataatcattaaaatcacttttgtagccaagtctacaggagtgattttctttttttatccgatgataaatgtgttataataggtagcaaaagaggtgaagaaatgaatcaaacagtagaatatatcaaagaactaacagccattgcgtcgccaacgggcttcactcgggagatttcggactatttagtcaagactctagaaggttttggttaccagccggttcgcacagctaagggcggtgtcaatgtgaccatcaaaggtcaaaatgatgaagagcatcgctatgtgactgctcatgtagatacgctgggtgctattgtccgtgctgtcaaaccagacggccgtctcaaactggatcgtatcggtggctttccttggaacatgattgaaggtgaaaactgtaccgttcatgtggctagcacaggtcaaaaggtatcaggaaccatcctcatccaccaaacttcttgtcatgtctacaaggatgcaggaactgcagaacgcactcaagacaatatggaagtgcgtttggacgccaaagtaaccaatgaaaaagaaactcgtgctcttggcattgaggtcggtgattttatcagttttgacccacgaactgtcgtgacagagacaggttttatcaaatctcgtcatttggatgacaaggtcagcgcagcgattttgctcaatctccttcgcatttataaggaagagaagattgaattgccagtaacaacccattttgctttttcagtctttgaagaagtgggacacggtgccaactctaacattcctgctcaggtagtagagtatctggctgtggatatgggggctatgggagatgaccagcaaacagatgagtatacagtatctatctgtgtcaaggatgcatcaggtccttatcactatgacttccgtcaacacttggtgaccttggcgaaagaacaagatatcccatttaagctggatatctatccattttatggttcggacgcttcagcggctatgtctgcaggtgcagaagtcaaacacgcccttctcggtgctggtatcgagtctagtcattcttatgagcgtactcatattgactcagtagtcgcaacagagcgtatggttgatgcttaccttaagagcaatttggtaaattaatatgtgccttatatgtcagagaattgacctcatcaaagctgggaaaaatccttactttgtaagagagttggaaacaggctaccttgtaatcggagaccaccagtattttgcaggctatagcctctttctagctaaggaacacgttaccgaattgcaccatttgaaaaaggaaacgaaactccgttttctggaagaaatgagtgtggttcaagaggcagttgctaaggcctttgttgctgaaaaaatgaatatcgaactgctaggaaatggtgatgctcatcttcattggcatctgtttcctagacgaacagatgatatgaatggtcacggtctcaaggggcgtgggccagtctggtgggttccctttgaagaaatgacctcagaaacctgccaagcaaaaccggatgagattaaaagattagtcaaatgtttatcgtcagaactaaataaactattagaaataaaggagtagaaatgaaaaaaagataccttatcttgacagccttgctagccttgagtctagcggcttgttcacaggaaaaagcaaaaactgaagatggcgcagctaagacagaacaaacagccaaagctgatggaacagtcggcagtaaatctcaaggagctacccagaaaaaagcagaagtggtaaacaaaggagactactacagcattcaaggaaaatacgatgaaatcatcgtagccaataaacactatccattgtctaaggattacaatccaggggaaaacccaacagctaaggcagagttgctcaaactcatcaaagctatgcaagaggcaggtttcccaatcagtgaccattacagcggttttagaagttatgaaactcagaccaagctctatcaagattatgtcaatcaagatgggaaggcagcggctgaccgatactctgctcgtcctggctatagcgaacaccaaacaggtttagcctttgacgtgattagtaccaatggagaattggtcacagaagaaaaagcagctcaatggctcttggaccacgctgctgattatggctttgttgtccgttatctcaaaggtaaggaaaaagaaacaggctatatggctgaagaatggcaccttcgttatgtcggaaaagaagccaaagaaattgctgagactggtctcagtttggaagaatactacggctttgaaggcggagattacgtcgattaatattcttcgaaaatctcttcaaacaatgtcagcggcgccttaccgtaggtatggttactgacttcgtcagttttatctgcaacctcaaagctgtactttgagcagcctgcaactagcttcctagtttgttctttgattttcattgagtataaaaaataaacttttctcttgcaattatagataaatagtgtataatagatgagtatgtgtaaagcatacttgtgggaggtaaaaatctctaattaccgccaaaaccacaaaggaggatttaaaaatggctaaaaaagtcgaaaaacttgtaaaattgcaaatccctgctggtaaagctacaccagctccaccggttggacctgctcttggtcaagctggtatcaacatcatgggattcacaaaagagttcaacgctcgtacagctgaccaagctggtatgatcattccagttgttatctcagtttacgaagataaatcatttactttcatcactaaaacaccaccagctgctgttcttttgaaaaaagctgcaggtgttgaaaaaggatcaggtacacctaataaaactaaagttgctacagttactcgtgcgcaagtacaagaaattgcagaaactaagatgccagatttgaacgcagcaaacgtagagtctgcaatgcgtatgatcgaaggtactgctcgttctatgggattcactgttgttgactaatcaataacacccccaatataacccgcaagacttcatcatttcgagaagtgacgtgggagatgaaaatcgattgaaccacttacaaggagaatagaaaatggctaaaaaaagcaaacaacttcgtgctgctcttgagaaaatcgacagcacaaaagcatacagcgtagaagaagctgtagcacttgcaaaagaaactaactttgcaaaatttgacgcaactgtagaagttgcttacaacttgaacatcgacgttaaaaaagctgaccaacaaatccgtggagcaatggtattgccaaacggtactggtaaaacttcacgcgttcttgttttcgcacgtggtgcaaaagctgaagaagcaaaagctgctggtgcagactttgttggtgaagatgaccttgttgctaaaatcaacgacggttggttggacttcgacgtagttatcgctacacctgatatgatggctcttgttggacgtcttggacgtgtccttggaccacgtaacttgatgccaaaccctaaaactggtactgtaacaatggatgttgctaaagcagttgaagagtctaaaggtggtaaaatcacttaccgtgctgaccgtgcaggtaacgttcaagcaatcatcggtaaagtatcatttgaagctgaaaaattggttgaaaacttcaaagctttcaacgaaacaatccaaaaagcaaaaccagctacagctaaaggaacttacgtaacaaacttgactatcacaactactcaaggtgttggtatcaaagttgacgtaaactcactttaatcagtagtttataaacaaagacgagtacgaaagtgctcgtttttttggctcattgtcaactgtagtgggttgaagaaaagctaagatcgagaaaggacgaaatttgtcctttcttttttgatattcagagcgataaaaattcgttttttgaagttttcaaagttccgaaatccaaaggcatttcgcttgataagtttaacgagattattggtcgcttccaatttggcgttggaatagggtagttgaagggcgttgataatcttctctttatcctttagaaaggttttaaagacagtctgaaaaagaggatgaacctgtttaagattgtcctcaataagtccgaagaatttgtctggctccttgttctgaaagtgaagaagtaagagttgatagagattatagtggtgtttcaactcttctgaatagctcaaaagcttgtctagaatctctttattcgttaagtgcatacgaaaagtagggcgataaaatcgtttatcactgagtttacggctatcctgctgtatgagcttccagtagcgcttgatagccttgtattcatgggatttttgatgaaactgattcatgatttggacacggacacgactcatagtacggctaatgtgttggacaatatggaaacgatccaacacgattttatcgtttgggagtgaaacagtctgggagactgtttcagcctgagcatagaaattagaaagcgaagctgtttagctaattcatagtagggactaaacatatccatagtaatgattttcacctgacaacgaacggctctatcgtagcgcagaaagtgatttcggatgatagtctgggttctaccttcaagcacggtgataatgttgagattgtcaaaattttgcgcaataaaactcatctttcccttagtgaaggcatactcgtcccaagacataatctcaggaagatgagaaaaatcatgcttaaagtggaagtcattgagctttcgaatgacagttgaagttgaaatggccagctgatgtgcaatatcggtcatagaagtcttttcaatcaacttttgcgcaatcttttggttgataatacgggggatttggtgatttttcttgacgatagaggtctcggctaccatcattttagagcaatgatagcacttgaaacgacgctttctaaggaggattctggtaggcataccagtcgtttcgaggtaaggaatcttagagggtttttgaaagtcatatttcttcatttgacttccgcaatcaggacaagatggagcctcataatccagtttagcgatgatttccttgtgtgtatctctattcacgatatccataatttggacattagggtctttgatatcgagtagttttgtgataaaatgtaattgttccatatgaatctttctaatgagttgtttggtcacttttcattatagatcttatgggactttttttctacaacaaaataggctccataatatctataggggggttacccactacaaatattatagagccgtttttttgtctttagttttatttcattagcccaaaccttcttgaaaaatctcaaaagttggtagaaaggtttgtgtttatcaattactcatttgattttaataagattatttaagtatataaaagggttcaaaggggatattaataaaaatgtgtaaaacttagtaataatatacgtaatatattaaaaaaattatcaaataagttgcttttaaaagatgaatatggtatcattaatttgtatgctaaaaacagtttttttgatataggtcacttcttatattaataactttatttgtaaggagttttactatcgattaaattggaggcaacaaaaaaataaggaggatttcattctaaatgaaaaataaacaacaagattttagaacggaaaagtacattcgttacggtattcgtaagtacagctttggtgcagcatcagtagcaattgcagctggtttgatgttcctaggtaatggcgcggtatcagcgacggaagtacaaggcacagaaactgcagtagcagcatcagctccagctgaaaaagctgatcagaatactgcagaagtgaaacctgagactacaaaagcagaagaagcaaaaacagaagaagcaaaaccagtagctaaagtagaggatgctaaaaaagtaaataaagctgtcctagaagcaagtattgctactttggagtctaaactttcaactgctaaatatgcagatgctacagtagtaagctcagctaaggaagtattggcagcagctaaagcaactcttgcaaaagcagatgctagtcaagctgatgtagatgctcaagcagaaactgtatcagcattgagtactgtagttactgagtcaaatactgctggtttcgataaaaagaaagcagctgaaaaagaagctgctaaagcagaagttgaaaaaaaatctactccagcagaaaaaactctttcagaagctaaatcagcgcttgacaaagcttcatcagaagcagatgtaacaaacagacttgcaaaatctgaactttctaagaaggaagtgaaggaagaaaataaagcagctgttgaagcggcagtagctaaaaaccaagcagttctttctgaaacaaaagctcttttagctgaaaagagcgtaacaaaagaacaagtagatgctcaattggaacgcctcaacgagtctattcttgcagtttacaatgaattgaaaaacgcaggaatcggtcgtgatggtaagttcgcaatcaacttggaagacgctcaaacaacagcacttaaagatgcaacagcagaaacaggtgcgaaatggttggaacaaaatggttataaatctttagctgaagctcctaaatatatcaaaggaaatgcagatgatgataaagccattaaaaacctaaacaaccaaattcaatggttggattttggagatgatacggcttggacaaacagaaaagcaaataaacaacttcaagtaggttcagtttatgaaaaagaattgatgcctggatacattgtaaaaatgactgttaaggaattgaaaccattccatgcaacagaaatttataaaaaccgtgtagctggaactagtcatgaagcatcatataaaccgaatgaagaaaatatctttaaccaggttactaaaaatccattttctacaggtatcagtggtaatcaacaaactggatatacacacgttaaaaacgctggattagatacaggttcagcaaaaacaacgattgcaggtactgatgatagtggtacaggacgtgatggtcaaatcgttggtgtcaagtttgctattgaagctacatacaatggtaagccggttaaacctggtatcgttatgacatcaggggaagatatcggtagtttagagacagaaatctatacaacgaatggtacaccttgggaattagcaggagttgttggttctactaatggtcatactgatatgtataaaccacaccctaactttaacagattaaatgagtggggtggaaatttaaacaaatggactactgaagaattacgaaatgctattgatggcaaaatgtttgctactaaagatgcagcaactgcaggtttaggatcacaagtgttcggaggctacacgaacggagactctgctacgccagtagtgtctacttcaaatgtaactgaagtaggattttatatcatgtcttctggacaacaatcatctatgattggtattaaattctctgactttggagatcttccagaatcatatggagcagctgaacacttcttaagaactcaagctaaagattatcaaacaggtcaaattaaccaaattcagcaaccttacctagggactgtcaaagctgatatcgattcagtatctggtacacgtgttcgtggtgtcgattcagatgatacaaaagagcaaggtgatgaaggtgtagctcagcttattgctccagaagatgtgcatattaacaaagataacggtgaaccagaagttaaaattgtacaagctgaagataatacataccgtgttaaagtgattgcatcagcaaatggtaatgataactatgatggtacagtaggccctgcttatgtgcgtggatttatcgatttcaatgggaatggtaaattcgatgaaggtgaagcttctgaagttgttacagtaaatggtaaccaacaaacagtagaactagttttcaaaaatactcaagttattgatactactaaaaatgcagttaacttccgtacgcgtattgcgacagatagaaaacaaattgaaaaaccagtgggaattgctttctcaggtgaggtagaagataaccaaatccaagtatctattcctccacgtggagataaggaagaaacaactggtaaacaaggtgagactcaatctgtaggtattgaatttgtatcacgtgctcaaggagatgatgcttcagatcttggatcaaacaatggtaaaactacctttaattcatacggtaaactagattattctgaacaaggaaactcaatcagcacagaaacaactaagaaaaaacaagctgaaggtgtaatgattgtagatccagaaggaaacttagttaaatcatacactaaagctggtcaaggtacttatacagtaactgatgataaagtaaccttcactccagaagcaagctttgttggaaaagctgatggtatcgttttgcgtgcggtagatgctaatggtcaatcaactggatggacagcacttacggaacaacatggtgtagaaaacattaatgagggatctcatactactgcaactaaaacaatggatgctgtttatattccaacagtaacaccaaaagaaatcactgcagacccagaagaatcaacagatgtacaaggtaaagctcaaaagaaaactccaactttcacagcaggtgcagatacagagaatccaacaccagtaacaccaagtgcacaatatccagctaaattagttgatccagctactggacaaccaactgatgcaacatctgtaactgtagaaggacaaggaacttacacaattgatccaacaacaggagaagtaacattccaaccgcttccaaactttactggaacagcgactggaatcggtgtatcactaacagctcctgtaggtcaagataaagatagaaatcctgtaacagcttcagctacaactacatatacaccaactgtgacaccagtaacaccgacagctgccccagctacttcaactggagtacaaggtgaaacacaaaaaggaactcctacatttacagaaggaaattctgaagttccaattaaagaaggctctgtcaaactattgaatccagatggaacagaagcaactggaccagttgatgctttagatgaaaaaggtaataaggttggtgaatacactgttaacccagctacaggtgaagtaacattcacaccaactgataaaacttacactggtaaagtaacaccagctaaagttcaagcagaagataaaaacggaactaaagtttctacaacttacacgccaacaatcgtaggggtaacaccaacagcagacccagctaaatctgtcgatattcaaggtgcaactcaagaaaatacagtttcatttgaacctggtaagactacaattgctggagaagaaaaaacggtagagatcgatccatctacttacactcttcttggtgaagatggacaaccagctacagaagtaccagctaaagatccgaatggaaaagtaattggtaaatacactcttaaaactgtagatggaaaagctgttgcagtatttgaaccaacagacaaaacatactctggagaagttcaaccagtaaaaatccaagctaaggataaaaacggaacagctgttgaaacaacttacacaccattaattacaccagtaacaccaaccgcggaaccagctgaaacaacagatatccaaggtaaagaacaaactggtaaaccaacatttactccaggtaatccaaatgttccaatggatgatgatactccagcgaccttcgaagatggatcaaaagaaaaagttgtaccaggcgaaggaacatacacagttgaaccagatggaacagtgaaattcacaccagaaaaaggatttacaggtaaaggaacaggcgtaaccgttaaacgtgtagataagaatggcacaccagtgacagctaaatacactccaacagtaacaccagtaacaccaactgcggaaccagctgaaacaatagacatccaaggtaaagaacaaactggtaaaccaacattcactccaggtaatccaaatgttccaatggatgatgatactccagcaaccttcgaagatggttcaaaagaaaaagttattccaggcgaaggaacatacacagttgaaccagatggaacagtgaaattcacaccagaaaaaggatttacaggtaaaggaacaggcgtaactgttaaacgtgtagataagaatggcacaccagtgacagctaaatacactccaacagtaacaccagtaacaccaacaggaacagacgctgtaacagaagatgttcaaggttcaactcaaacaggtaaaccaacatttgaaggtggaaaagtaacagtaaatggtgaagaaaaaactgttgaaatcgatgaagataaaccagctaaattggtagatccaaaaacaggtgatccagttgattcagtaactatcgaaggcgaaggaacatatacagtgtctcctgacggaacagttacatttacaccagagaagaacttcacaggtaagggaacaggtgtaacagttcaacgcgaagataagaacggcacaccagttaaagctacttacacaccagttgtaaaaccagcaacaccaacaagttcagatgttattactacaaatgttcaaggtgctactcaatcaggaacaccaacatttgaaggtggaaaagtaacagtcaacggtgaagaaaaaactgtagaaatcgatgaaactgttaaaccaacatttgatgatggtacaactgagaagaaagtaccaggtgaaggaacatacacaatcgatgagaacggtacagtaacctttacaccagagaagaacttcactggtcaagcaacaggtgtaacagttaaacgtgtagataagaacggtacaccaatcacagctaagtacactccagtagtcgttccagtaacaccaacttcaaaagatactgaatcagaaggtcctaaaggacaacctcaatcaggaacaccaacatttgaaggtggaaaagttacaatcaacggtaaggaagttccagttgaaatcgatgaaacagttaaaccaacatttgacgatggcacaactgagaagaaagtaccaggtgaaggaacatacactatcgatgaaaacggtaaagtaaccttcacaccagagcctgacttcgtaggaaaagctaaaggtgtaacagttaaacgtgtagataagaacggtacaccagtaacagctacttacactccaacagttcgtcctgatacttcattcgttgataaagatggtaacccactttcaccaacagaagatggaactaaaccaactaaagacatcccaggatacaagattgttaaaactgagattgacgaaaaaggaaatacaaaacacatctacgagaaagtgacaacaacttataaagataaagatggcaatgtaattccaaactatccaacagaagacggcgaacaacctaagaaagatatcccaggctaccgcttcgtagaaactaagaaacttccaaatggagatacagagcacgtctacgaaaaagttaagacatcattcaaggataaagaaggaaacgagattccaggtaatccaagcgaagatggcgaccaacctaagaaagatatcccaggctaccgcttcgtagagactaagaaacttccaaatggcgatgtagaacacgtttatgagaaagttaagacaagtcacaaggataaagacggaaatgaaattccaaactatccaacagaagatggcgaccaacctaagaaagatattccaggttaccgcttcgtagagactaagaaacttccaaatggcgatatcgaacacgtctacgaaaaagttaagacatcattcaaggataaagaaggaaacgagattccaggaaatccaagtgaagatggcgaccaacctaagaaagatatcccaggctaccgcttcgtagagactaagaaacttccaaatggcgatatcgaacacgtctacgaaaaagttaagacatcattcaaggataaagaaggaaatgagattccaggaaatccaagtgaagacggcgaccaacctaagaaagatatcccaggctaccgcttcgtagaaactaagaaacttccaaatggagatacagagcacgtctacgaaaaagttaagacatcattcaaggataaagaaggaaacgagattccaggtaatccaagtgaagatggcgaccaacctaagaaagatatcccaggctaccgcttcgtagagactaagaaacttccaaatggagatacagagcacgtctacgaaaaagttaagacatcattcaaggataaagaaggaaacgagattccaggaaatccaagtgaagatggtgaacaacctaagaaagatatcccaggttaccgcttcgtagagactaagaaacttccaaatggcgatgtagaacacgtttatgagaaagtttcaactccagcaccaacgccaacgccaactccatcaacaccagtttacgaaaaagtattaacaacttatgtagacgaaaatggtgaattgattattccgaatgaagatggttcacatccacgtaaatcattagaaggttatgagttggttcgtacagaaacagatgctaatggaaatgttcgcaatgtttaccgtaagattcaatctcaaaaaccagtacaaccagttgagccagctactccagcaatgcctgaacagccagctaaacctcaagtaccggctactccagcacaaccagtacaaccaacagcaatgaaagaagctgaaggtaaacgtgaattgccaaatactggtacagaagacaatgctagcctagcagcacttggacttctcggagtattgagtggatttggtcttgtcgctcgcaagaagaaagaagactaagccttctaattgacatgatttgtttgcaatgaacagattatccttaaaactgatgaatcgaaagattcatcagttttttggctattatggctacagagtgagtagcgaaatcgggctctttgggagtaaataatgattatactttcatatttcggagaaaatatggtataatagagagtaaaaactttgaaagaaagaaaaagatgaatttaaaagattatattgcaacaattgaaaattatccaaaggaaggcattaccttccgtgatatcagtcctttgatggctgatggaaatgcttatagctacgctgttcgtgaaatcgttcagtatgctactgacaagaaaattgacatggttgtaggacctgaggctcgtggatttatcgtgggttgtccagttgccttcgagttgggaattggttttgcacctgttcgtaagccagggaaattaccacgtgaagttatttctgctgactatgaaaaagagtacggtgttgataccttgactatgcacgcggatgccatcaagccaggtcaacgtgttcttatcgtagatgacctcttggctacaggtggaactgttaaggcaaccattgagatgattgaaaaacttggtggtgttgtggcaggttgtgccttccttgttgaattggatgaattgaacggccgtgaaaaaatcggtgactacgactacaaagttctcatgcattattaatgaaaaacagtccctagggctgttttctctacattaggatataaaaacagactatagctagttagagaaaaactataattgaaaactatatcttcttacagtataataaaaggaacaagtgtttgagatttgacttcaaacacatgcaatgattcctgaaaagtacagttaggagagagttatgccgattcgaattgataaaaaattaccagctgttgagattttacggacagagaatatctttgtcatggatgatcaacgcgctgcccaccaagatatccgtcccttgaagattttgattttaaatcttatgcccaagaaaatggtgacagagactcagttgttgcgccatttggccaatacacccctacaactggatattgatttcctctatatggagagccatcgttctaaaacaactcgatcagaacacatggagaccttctacaaaacttttccagaagttaaggatgagtattttgatgggatgattatcacgggtgctccagttgagcatttaccatttgaggaagtggactattgggaggaattcagtcaggttatcgagtggtccaagacccatgtctattcgacccttcatatctgttggggggctcaggctgggctttatctccgctatggggtagaaaaataccagatggatagtaagttatcaggtatttatcctcaggataccttaaaagaagggcaccttctctttagaggctttgatgatagctatgtatcccctcattcacggcacacggagatttccaaggaagaaattttaaataaaaccaatctagagattttatcggaaggacctcaggttggggtttcgattttggccagtcgtgatttacgagaaatttatagttttgggcatttggaatatgaccgtgataccttggcaaatgaatatttccgagatcgtgacgcaggtttggatcctcatattccagaaaattactttaaggatgatgatgtcaaccagacaccttgtctttgttggtcttcatcagcagccctctttttcagcaactgggtgaactatgccgtctatcaggagacgccttttgactggagaaagatagaagatgatgcatctgcatatgggtatttataagaggaattatgacatatttagacgcttttaaatcagggaacttggttttaccgagtgccctgctcttgcattttaaggaactctttccttccagtgacgattttctggtctggcaatttttctatttgcaaaatacgacaggcttagaagaaatgtccccaagccagattgctgaaaggattggcaaggaaatttcagatgtaaaccaggctatttccaatctgacggagaggggactgcttcagtatcgaacgattgaattgaatggtgaaattgaattactttttgatgccagtctagccttggaacgtttggacgacttgcttggagctgttcaatcaagttcagaccaattggcacctcaaaatcagcttaaggatttggtggaaaccttccaacaggagttgggtcgcttgttgacgccttttgagattgaggatttgaccaagactcttaaggaagatgggaccagtgctgacttgattaaggaagctcttcgtgaagcggttttgaatggcaaaccaaactggaagtacattcaggcgattttgagaaattggcgccatgaaggcatcaaaagtgtggtccaaatagaggccaagcgggcagaaagagaagcaagcaatcctcagttgacacaggtatcggcagattttagaaatgccatggatctttggaaggattaatagttggaagcaggcttgaaatccgagtaagatttgcaagctgtgtctaattgtgataaaataaatagaaaataaattgaaaaaagaggtatgtgaaatgtcacgtaaaccatttatcgctggtaactggaaaatgaacaaaaatccagaagaagctaaagcatttgttgaagcagttgcatcaaaacttccttcatcagatcttgttgaagcaggtatcgcagctccagctcttgatttgacagctgttcttgctgctgctaaaggttcaaaccttaaagttgctgctcaaaactgctactttgaaaatgcaggtgctttcactggtgaaacaagcccacaagttttgaaagaaatcggtactgactacgttgttatcggtcactcagaacgccgtgactacttccatgaaactgacgaagatatcaacaaaaaagcaaaagcaatctttgcaaacggtatgcttccaatcatctgttgtggtgagtcacttgaaacttacgaagctggtaaagctgctgaattcgtaggtgctcaagtatctgctgcattggctggattgactgctgaacaagttgctgcatcagttatcgcttacgagccaatctgggctatcggtactggtaaatcagcttcacaagacgatgcacaaaaaatgtgtaaagttgttcgtgacgttgtagctgctgactttggtcaagaagttgcagacaaagttcgtgttcaatacggtggttctgttaaacctgaaaacgttgcttcatacatggcttgcccagacgttgacggtgcccttgttggtggtgcgtcacttgaagcagaaagcttcttggctttgcttgactttgtaaaataatcagtagcaaaagctaggtggaacagcattcagatgtctgttccattttttataggagaggaaagattgaaaacaaagattggaaaaattggattagcaagtgcctttttgcttggattgatcgttaatcaggtggctgcaaatgaagctgaagtgaaagcatcttcggaagaaagcagtgttcaagcttcttctagtaaggtagaagaaaagaaatcagaaacgactacaagtcaaaaagaagaagagaaaaaggttgagacttcttctagtcagcgtccagagaaaaaggaagaagtaaaagagacgcgagctagtagtcagaaagaagaaagtaagccaaattcaacatcagcacattgggaaggtgacttctatgtaaaagcagatggttcaaaagctaagagtgaatggattttcgatactagctacaatagttggttctatataaaagcagatggtcgttatgcccaaaaagaatggcatggaaactactacctcaaagcaggtggatacatggctaaaaatgaatgggtttacgataacaattataagagctggttctacctcaaggcagatggttcttatgcagaacaagaatggcagaaaatcaatggcaaatggtactattttaagaagtggggctatatggctaaaagtcagtggcaaggaaattatttcttgaatggtcaaggtgccatgatgcaaaacgaatggctttacgataatcattataagagttggttctatcttaaggcagatggttcttatgctaatgaacagtggcaaaagattgatggcaagtggtattatttcaagaagtggggctatatggctcaagatgagtggcatggaaactactatcttactgaaagtggtgtcatggcaacaggtgagttaatcatggacgatactcgttatacttttgctgattcaggggaactgaaagaaaagaaagccttgaatgttggttgggtttatcgaaatggacaccgttatttctttaaccatcgtgaagaacaggtcggaactgaccgtgctaagaaggttattgatgtcagtgatcataatggccgcattagtgattggaaaaaggttatccaggaaaatggagttgatggtgttattgtgcgcttaggatacagcggtgtagaagataaggaattggcacataatattcaagaatttaatcgactaggtattccttatggtgtttatctttatacctatgcagaaaatgaaacagatgctgagaatgatgctaagcagactattgaactcttgaagaaatacaagatgaacttatcttatccaatctactatgatgttgaaaactgggagtatgaaaataaatctaagaaagctccagcagatacagacacttgggttaaaattatcaataagtatatggaaaccatgaagcatgctggttaccaaaacgtgaaagtttatagctatcgtcaacttttgcaaactcgtttgaatcatccaaatattttacaacatgtaaactgggttgcagcttatacggatgcgcttgattggaacaatcctcattattcaggagaaaaaggatggcaatatacttcatctgactctcttaaagggatacgaggacaggttgatgtcagtgtctggtattaagatgtaaaatgagaaaagagcctacaaattgtatactctttttctttattttatagctgttaagagagtttgaaagtgactaggttttattctaaaaaaatcttaaattatcagtctattgcaacttttctcatgtgagtcatttggcttgctattggttttccttagtagtatactaaggtagtaatcattaagaagtggttacaaataataatgaatgaggtaaaataaaatggtagaattgaaaaaagaagcagtaaaagacgtaacatcattaacaaaagcagcgccagtagcattggcaaaaacaaaggaagtattgaaccaagctgttgctgatttgtatgtagctcacgttgctttgcaccaagtgcactggtacatgcgtggtcgtggtttccttgtatggcatccaaaaatggatgagtatatggaagctcttgatggtcaattggatgaaatcagtgagcgtttgatcacacttggtggtagcccattctctacattgacagaattccttcaaaacagtgaaatcgaagaagaagctggtgaataccgtaatgttgaagaaagcttggaacgtgtccttgctatctaccgttacttgtcagaactcttccaaaaaggtttggatgttactgatgaagaaggtgacgatgtgacaaacggtatctttacagatgctaaaactgaaactgataaaacaatctggatgcttgccgcagaacttggacaagcacctggtttgtaagaaatagaataatcatataaaaatctgtaggatgcctcttacagatttttttctattctgtaagctattccaaaccagtctttttttgagttttttgataaaatagtactatcagtgaaaaggatggaagcatgactaagaaaatcgtagctatttgggcccaggatgaagagggtgtgattggtaagggaaatcgcctgccttggcatttgccagcagaactgcaacacttcaaagaaacaactctgaatcatgctatcttgatggggcgtgtgacctttgatgggatggggcgtcgcttgcttccacaacgggaaactctgattttgacgcgtaattctgaagaaaagatagacggggttactacttttcaggatgtccagtctgtcttggactggtatcaggctcaagaaaagaatctttatattatcggtgggaagcaaatttttcaggcttttgaaccctaccttgacgaagtaattgtgactcaaattcatgctcgggtggagggagatacctatttccctgaggagtttgatttgtctctttttgagacagtttcaagcaaatcctataccaaagatgagaaaaatccttatgattttaccatccaataccgcaagagaaaggaagtctaatggaacgtagtatatttggttttttcacagccatgctgtgtttggtctgcttacttgcaggagcacaggcttttcgtaaaaagcgttatgggctttctgtcctgctctggttaaatgcctttaccaatttggtcaatagtatccatgctttttacatgaccttattttagatagaatgacagtatagaatagaacggaaggaaatcatgcctacaaataggaataatgatatgatggtttattgctcattttgtggcaaaagccaagaagaagtacaaaaaataatcgcaggtaacaacgcctttatctgtaatgaatgtgtggagttagcccaggaaatcattcgagaggagttggcggaagaagtcttggcagacttgtctgaagttccaaaaccaatcgaactcctccatatcttgaaccactatgtaattggtcaagatcgtgccaaacgtgccttggcagtggcagtttacaaccactacaaacgcatcaatttccacgatacgcgtgaagagtcagaagatgtggatttgcagaagtcaaatatcttgatgattggcccaactggttcagggaaaacttttcttgcccagaccttggctaagagcttgaatgtgccttttgcgattgcggatgcaacagctcttactgaggctggttatgtgggtgaggacgtggaaaatatcctcctcaaactattgcaggctgctgactttaacattgaacgtgcagagcgtggcattatctatgtggatgaaattgacaagattgctaagaagagcgagaacgtatcgatcacacgtgacgtttctggtgaaggggtgcaacaagcccttcttaagattatcgagggaacagttgccagcgtaccgcctcaaggtggacgtaaacatccacaacaagagatgattcaagtggatactaaaaatatcctcttcatcgtgggtggtgcctttgatggtattgaagaaatcgtcaaacaacgtctgggtgaaaaggttatcggatttggtcaaaacaataaagcgattgatgaaaacagctcttacatgcaagaaatcatcgcagaagatattcaaaaatttggtattatccctgagttgattggacgtttgcctgtctttgctgctcttgagcaattgacggttgatgacttggttcgtatcttgaaagagccaagaaatgccttggttaaacaatatcaaaccttgctttcttatgatgatgtcgagttggaatttgacgacgaagcccttcaagagattgccaacaaggccatcgaacgtaaaacgggtgcgcgtggtcttcgctctattatcgaggaaaccatgctagatgtcatgtttgaagtaccgagtcaggaaaatgtgaaattggtccgcatcactaaagaagctgtcgatggaacggataaaccaatcctagaaacagcctagaggtgactatggaacttaatacacacaatgctgaaatcttgctcagtgcggctaataagtcccactatccgcaggatgaattgccagagatcgctcttgcagggcgttcaaatgttggcaagtctagctttatcaataccatgctgaaccgtaagaatctggctcgtacgtcagggaaacctggtaaaacccagctcctgaacttctttaacattgatgacaagatgcgctttgtggatgtgcctggttatggctatgcccgtgtttctaaaaaggaacgtgaaaagtgggggcgcatgattgaggagtacctaacgactcgggaaaatctccgtgcagtggtcagtctagttgaccttcgtcatgacccgtcagcagatgatgtgcagatgtacgaatttcttaagtattatgagattccagtcatcattgtggcgaccaaggcggacaagattcctcgtggtaaatggaacaagcacgaatcagcaatcaaaaagaaattaaactttgacccaagtgacgactttatcctcttttcatctgtcagcaaggcagggatggatgaggcttgggatgcaatcttagaaaaattgtgaggaaaagaaaatggcaaaaacaattcatacagataaagctccaaaggctatcggaccctatgttcaaggaaaaatcgttggcaaccttttgtttgctagtggtcaagttcctctctctcctgaaactggggaaatcgttggagaaacgatccaagaacagacagaacaagtcttgaaaaatattggtgctattttggcagaagcaggaactgactttgaccatgttgtcaaaacaacttgcttcttgagcgatatgaacgactttgttccttttaacgaggtttaccaaacggcctttaaagaggaatttccagctcgttcagcagtagaggtagctcgtcttcctcgtgatgtaaaagtcgaaatcgaagtcatcgcagagattggataagctagttgaagtttggtgttgccaaacttcttttgatataaggagagatagatgacaaagaaacaacttcacttggtgattgtgacaggaatgagtggtgcagggaaaacagttgccattcagtccttcgaagatttgggttattttactattgataatatgcctccagctctcttgcctaagtttttgcagttggtggaaacaaaggaagacgaccataagttggccttggtagtagatatgcgtagccgttctttcttctcagagattcaagctgttttggatgagctggaaaacaaggaagaactggactttaaaattctctttttggatgcagctgataaggaattggtcgctcgttacaaggaaaccagacggagtcacccactagctgcagatggacgaattttggatggaattaagctggaacgtgaactcttggcacctttgaaaaatatgagtcaaaatgtggtggatacgacagaactaactcctcgtgagctgcgcaaaacccttgcagagcagttttcagatcaggaacaagcccagtctttccgtatcgaagtcatgtcttttggttttaaatatggaatcccgattgatgcggacctagtctttgatgtccgtttcttgccaaatccctattatctaccagaactgcgtaatcaaacgggagtggatgaaccagtttatgactatgtcatgaaccatcctgagtcagaagatttctatcaacatttgttggccttgattgagccgattttgccaagctaccaaaaggaagggaagtctgttttgaccattgccatgggttgtacagggggacaacaccgtagtgtggcctttgccaaacgcttggcacaggacttatccaagaattggcctgtcaatgaagggcatcgtgacaaagaccgaagaaaggaaacggtaaaccgttcatgagaaaaccaaagataacggtgattggtggaggaactgggattcctgtcattctaaaaagtctgcgtgaaaaagatgtggaaatcgctgctatcgtaacggtggcggatgatggtggttcatcaggtgaactccgaaaaaatatgcaacaattgacaccgccaggtgatcttcgtaatgtccttgtggccatgtcggatatgcctaagttctatgagaaagtctttcagtatcgcttttctgaggatgcgggagcctttgctggccatccattgggtaatctcatcattgctggcctgtcagaaatgcagggttcgacctataatgccatgcagttattgagcaaatttttccatacaactgggaagatttatccttccagtgaccatcctttgaccctgcacgcagtctttcaggatgggacagaagtggctggagagagccatattgcagaccatccaggcatgattgaccatgtctatgtgaccaatacccttaacgatgatacgcctctggctagccgtcgagtggtgcagaccattcttgaaagtgacatgattgtcctcggacctggttctctctttacctctattttgcccaatattgtaattaaggaaatcgggcaggcgcttttggaaaccaaggcagaaatcgcctatgtctgcaatatcatgacccaacgtggggagacggaacactttacagatagtgaccacgtggaggtcttgcatcgtcaccttggtcgaccttttatcgatactgtcttggtgaatattgaaaaagtgcctcaggaatacatgaattccaaccgttttgatgaatacttggtgcaggtggaacatgattttactggtctttgtaagcaagttccgcgcgtgatttcatccaacttccttcgtctggaaaatggaggcgccttccacgatggggatttgattgtggatgaattgatgcggattatacaggtgagaaaatgagtttcacagtagcagtaaaagaagaaatcctaggtcagcaccatctgagccggcatgaattatctgccattatcaagatgtctggcagtatcggtctctcgacttcgggcctgaccttgtctgtcgtgacagaaaatgccaaactggctcgccacctctatgagtcctttctccatttctatgaaatcaaatcggaaatccgacaccaccaaagaagtaatcttcgtaagaatcgggtctataccgtttttacagatgaaaaggtgcaggaccttctgagtgatttgcacttggccgactctttctttggcctagaaacaggtattgatgaggcgattttatcggatgaggaagcaggtcgtgcctatctttgtggtgccttcttggcaaatggaagcattcgtgaccctgagtcaggcaagtatcagttggaaatcagttctgtttatctggaccacgcgcaagggattgcctcccttctccagcaatttttactagatgctaaggtgcttgagcgcaagaagggagctgtgacctatctccagcgagccgaagatattatggacttcttgattgtcatcggagccatgcaggcgcgtgatgattttgagagggttaagattttgcgagaaacccgtaatgacctcaatcgagccaataatgccgagacagctaatatcgctcggacagtctctgccagcatgaagactatcaacaatatcagcaaaatcaaagatatcatgggcttagaaaatctgccagtggatttgcaggaagtagcgcagttgcggattcagcacccagactactctatccagcagttagcagatagcctcagcacccctctgaccaaaagtggtgtcaaccacagactcagaaaaatcaataagatagccgatgagttataaagatataaaacacctctttcttgacaattaaatagagtatgtgagataataaaggggaattgagaagttctagcattttagtgctaacagaaatcccctcggtactgcaatactgaggggatttttttctaggttagatagcactaaccaggaaggttacttgtcgaagtgatcgtctaaccaacgagtcaccagccatgagatgatactctcgatgactgcgataagtactattttgagaagttctagcatctgtaatacctccttttccaaggcgtattgttagtgccgtccctattatatcacatgttttatcagtttgataggcatttttatttttgttaaagaagggggaaatatgagctaacaaattagccgatgaactataaaaccacgaatcctatgtgactcgtggttctttttctataaactagtagagtgttttggttgtactttttgttctgggtcgatgtagttaatggcattgttaacagcggttggtgcttctccaagccctgtcgcaatcagatcaatttttccgtcatagtagcaacagtcaccgatagcatagatacctgcttggctagattcttgcttgctattgacgataatcttgtgacggttgaggtccagaccccagtttttaaggttaccaacagaagatttgaaaccatagttgacaaagaggtggtctaggtcaatagtttctgtttcatcagatttgacttttgtgatttcaagtttatcgagtgtttttccatctccaaggagttggctagggacgaatggtgtcttgatgatcacagaagattcctgcaaagcttggacactgtgttccaaggcgcggaaattatctctacggtggacaagggtagttggcgcaattttttcaaaagctaaagcccaatcaacagctgagtccccaccacccagaatcgtcactttcttaccagcatattgctgaatgttagaaacgtggtagtggatattttcatagccctcaacgccttctagttccagcggacgtggtttgaaggcaccaccccccatagcaatgataacagttttagacagatgacttcctttagaagttgtgatgacaaatccttcttcttgtttttcaatctcaagaaccgtttcgttgagatgaataggggtatcaaagccatttaattgctcgattagacggttagtcaactcttctccagtcaggtttgggaaacccgggacgtctaaaatttccttttcagggtagagaatagcaggttgtccacctagttggggaagagagtcgatgatttggaccttggcttggcgtaggtgggcatagaaggctgcaaaaagcccgacaggaccaccacctacaatggtaatatcatagagttgagacatggtttctcctttgttttttctagtcagtttattttatcatatttttccttaatttaaaatgaagtaggatagggaaaaaaatgccagaaaaatggtataatagaaaggaacgtgtttggacagagaggagacagcagatgaactttcaacaattatccaatctgcaatattggactagcttgttttctagtccttggagtattgccatcaatctgtttgatattttgattgtggcctatattttatatcgttttacaaaagcgatagctggcaccaagattatgattttggtgcgtggggtcgtgatctttgtattagcccaggttgtggccaatatccttgatttaacaacgatttcttggttgattaatcagattatcacctatggggttattgctgcggttgttatcttctctccagagattcggactggtttggaacgcttgggaagggcgacagatttcttttctactgctcaaattagtgcagaggagcaaatgattcgtgcctttgtcaagtcggttgaatatatgagtcctcgtaagattggtgctctggttgccatccaacgagttcggaccttacaagaatacattgcgacagggattcctttggatgccaatatttcagctgaactccttattaatatctttatccccaacactcccctacacgatggtgctgtgattatcagagaaaatcgaatagcagtaacctctgcctatcttcccttgacagaaagcacagggatttccaaggaatttgggaccagacaccgggcggctatcggtttgtcagaagtatccgatgccttgaccttcatcgtctcagaggaaacaggaggcatttctattacctataacggtgttttcaagcacgacttgacgattgaagaatttgaagcagagctacgagcaattcttttgccagctgttgaggaaaaagtcagtttcaaggaccgtttgctaggaggttggaaatatgagaaaaaatagtctatatatcatttcatctctcttttttgcttgtgtcttattcatttatgcaacgtcaaccaactttcaaaatagcaataccgcaaggcaggtcaaatcagaaacctacaccaatacgataacgaacgttcctatcgatattcactatgataatgaccagtatttcattagtggatttgcatcagaagtttcagtgatattaaccggagctaatcgtgtgaccttggccagcgaaatgcaggagagcactcgtaagtttaaggtcacagcggatttgacggatgccagtgttggaacgattgaagttcccttgaatattgaaaatcttccaagcggattgaccgctgtggcaacgcctcaaaagattacagtgaaagttgggaagaaggttaagcgagatgggatgattgttgtgccacaagttgaccaaagccagattgattccaagctacaaattgatagtgtaaccgtgtcaaacgaacgagtttctgtcacaactgaccaagaaacattagctaaaatcgatcgtattattgcgcttttaccaaccagcgaacgcataaccggtaattacagtggttcagtacctttgcaggcaatcgatcgcaatggtgttgtcttaccggcagttattactccgttcgacacaacaatgaaggtgactacaaaaccagtagcaccaagttcaagcacatcaaattcaactacaagtagttcgtcggagacgtcttcgtcaacgaaagcaactagttcaaaaacgaattaaaaatagaaaaaggattttataaaaatgggtaaatattttgggactgatggagtccgtggagaagctaatgtagaattaacgccagaattggcctttaaactaggacgttttggaggctatgttcttagccaacatgaaacggaagcgccgaaagtttttgtaggacgtgacacacgtatttctggggaaatgctagaatctgccttggtggcaggtctcctctctgtagggattcacgtctacaaacttggtgtccttgcaacaccagcagtagcttacttggtaaaaactgagggagccagtgcaggtgtcatgatttctgctagccacaacccagcccttgataatgggattaagttctttggtggtgatggtttcaaactagatgatgaaaaagaagcagaaattgaagccttgctagatgctgcggaagacactcttcctcgtccaagtgctgaaggcttgggaaccttggtagattatccagaaggtttgcgtaagtatgaaggatatcttgtttcaactggaactcctcttgaaggaatgaaggttgccttggatacggctaatggtgcagcttctacaagtgcccgtcaaatctttgcagatcttggtgctcaattaactgttattggggaaacaccagatggtcttaacatcaaccttaatgttggttcaacccacccagaaacccttcaagaagtggtcaaagaaagtgactcagctatcggtttggcttttgacggagacagtgaccgtttgattgctgtcgatgagaatggtgagatcgttgatggtgataaaatcatgtacatcatcggaaaatacctttctgaaaaaggacaattggcgcaaaatacaatcgtgacaaccgttatgtctaaccttggtttccacaaggccttggatcgtgaaggcattaacaaggcagtcactgcagttggcgatcgttacgttgttgaagaaatgcgaaaatcaggctacaaccttggtggtgaacagtctggtcacgtcatcttgatggactacaatacaacaggtgatggccaattatctgctgttcaattgacaaaaatcatgaaggaaactggtaagagcctgtcagagttggcagcaaaagtaaccatctatccacaaaaattagtcaatatccgagtggaaaatgctatgaaggaaaaggctatggaagtgccagctatcaaggacattatcgagaagatggaagaagaaatggcagggaatgggcgtatccttgttcgtccaagtggaacagagcccctcttgcgtgttatggcagaagctcctacaacagaagaagtggactactatgttgatactatcgcagacgtagttcgagctgaaatcgggattgactaaatcctagaaaactagatgaaaataaaaaattatggtacaatagcttataatattgtagccgagggagaaagacatgaatcttaaacgtgaacaagaatttgttagtcagtatcattttgatgcgcgtaattttgaatgggaaaatgaaaatggagctcctgaaactaaggtggatgtgaacttccaattaattcaacatgaccaagaaaatcaagtgacttccttgattgttgtcttgagttttatgattgtatttgataaatttgtcatcagtggaaccatttcacaggtgaaccatatcgatggtcgtattgttaacgaaccaagtgaattgaaccaagaagaagtggaaaccttggctcgtccatgtttgaatatgctcaaccgtttaacttacgaagtaactgaaattgcattagacttaccaggaatcaatttggagttctaatatgaaattagctgttatcacagattcctctgcctatctcagtgcagataccttgcaaagagaagatttatttgttttggatattcctgtcaatattgatggtgaggagtatgtcgaaggcatcaatctgactgctgaggaattttaccaaaaaatggctcaggcctctgaattgcctaagaccagtcaaccaagtattgccaagttagatgagattctaacttcgctcaaagaacaaggttacacccatgctttagggcttttcctatcttctggaatttcaggtttttaccaaaatatccagtatatggtggatgactatgagggcttaaccattgcttttccagacactttaatcacaagtgctcctctgggtatcatggttgaaagtgtctttaactggcgagaccagggcgatgactttgccattattcaggataagctagctattcagattagtcacacatctgctttcatcatggtggatgacttggaccacttggttaaagggggacgcctttcaaatggagctgcgattttgggcaatctgctaagcattaagccgattctttattttaatgaccaaggtgtgattgaagtgtacgaaaaagttcgtactgaaaagaaagcaaccaagcgtttaattgagattatcaaggaagcaacagcttcaggccaataccgtatcattgtcattcacgggaatgctcctgaaaaggctgaagaattgcgtcagcacttgctagattctgaagtgggtacggatatttcacttgctacatttggtagtgtcattggaacacacctaggagcaggaagtattgctctgggttatattccagtgatttagttagcacttctagactagttaagaaggcttgtatcttagaaattgaacacggactacctgcctcttgaaaaaagatgtctgtcttgccttttgtggaaagtcagcgccatcccctatttttcacgggcagctaaggccctttgtatcttgataattgaacacgcctggaaccctctgtgaaaaagataggtcttccaaggagtatttactccttgatcagaactcctattttcacgttgtgctcttacaggctttgtatcttagaaattgaacacggactacctgcctcttgaaaaaagatgcctgtcttgcctttcatggaaagtcagcgtcattccctatttttcaagggcagctatcgtcctttgtatcttagtcaggagtagagatgagtattcgagtaattattgctggttttaagggaaagatgggccaggctgcttgtcagatggtcttggctgatccagacttggacttggtagcagttttggatccctttgagtctgaatcagaatggcagggtattcctgttttcaaggataaggctgatttggtcggttttgaagcagatgtctgggtagactttactacaccagctgttgcctatgaaaatacacgctttgctcttgaaaatggctttgctccagtagttgggacaacaggtttcacgagtgaagagattgcagagctaaaagcattttctcgtgctcaagatttgggtggcttgatcgctcctaactttgccttgggtgctgttttactcatgcaatttgcaaggcaggctgctaaatatttcccaaatgtggagattatcgagctccatcatgacaagaaaaaggatgctccgagtggaactgctattaaaacagctgagttaatggcagaagttcgagagtctatccagcagggtgcagcagatgaggaagaattgattgcaggtgctcgtggtgctgactttgatggcatgcgcatccactcagttcgtttgccaggtttggtagcccatcaggaagtcatctttggcaatcagggagaaggattgacactccgtcatgactcctatgatcgcagctccttcatgacaggggtgaatttgggaattaaagaagttgtcaagcgtcatgagcttgtctatggattagaacacttattatgagattaacgcaaatgccttctgaatttcagaaggctttaccagtattagaaaaaattaaagaagcaggttttgaggcctattttgttggaggttctgttcgagatgccctcctcaatcgtcctatccatgatgtggatattgcgacgtcttcttatccagaagaaaccaagcagatttttccgcgaacagccgatatcggaatcgagcatggaactgtcttggtcttagatggggacgaggagtatgaggtgactacttttcggacagaggatgtctatgtggactatcgcagacccagtgcggtctcttttgtgcgctcgctagaagaagacctcaaacgccgtgatttcacagtcaacgcctttgccttggacgatacaggagaaatcattgacttgtttcatggtttagaagatttggaaaagcaagtcttacgagcagttggagtggcaagtgagcgtttcaacgaagatgctttgcggattatgcgtggtttccgttttcaagccagtcttggttttgaacttgagacagaaacgtttaaagcaatgaagaccttgacgccacttttggagaaaatttctgtggagcgtaccttcgttgagtttgataaactcttgctggctccattttggagaaggggtttggcttccatgattgagagtcaagcttatgactatctccctgatatggcatctagcaaagacaaacttaacagactgtttgatttggagactgatttcacctttgaatcttcagagcaagcctgggctgctctactgtgggctttggagattgaaaatgcgcagccatttttgaaggcttggaagacctcacgtcagtttgctaagcaagttcaggatttactgactattttggccttgcgtgaaaagggagaattgagcaagcgcgattgttatcgctttgacttggattttcttttacaggctgaaaatcttcgtcaggctcagggaaaaccagtcaacccacaagtcatcacagaaacctaccagagtctgaccattcatgacaagaaagaaatccaaatcaacggtggtattttgatcaaggaatatggctatcaaccaggtccagatttgggagagattttaacagagatagagtttgccattgtcgatggagaattggaaaatgaccgtcaagccatccatgcttatctaagggagaaaaaatgagtgattttatcgttgaaaaactaagcaaatccgttggtgacaagaccgtttttaaggatatttcctttatcatccatgacctagacagaattggtctaatcggtgtcaatgggactggcaagaccacccttttagatgttctttctggtgtttctggctttgatggggatgttagtcctttttcagctaagaatgattaccaaattggttacttgactcaagatcctgattttgataatagaaagacagttttggatacggttctatctagtgaactaaaggaaatccagctcattcgtgaatatgagttgattatgctcaactacagtgaggacaagcaggctcgtttggaacgggtcatggctgagatggattctcttcaagcttgggaaattgagagtcaggttaagacggttctctgcaagctggggattcaggacttatctactcctgttggggaattgtcaggtggtctgagaagacgggttcagttggcacaagtcttacttggtaatcacgaccttttgcttttggatgagccgaccaaccatctggacattgcgactattgagtggctgaccctctttttaaaaaattccaagaagaccgtcctttttatcacccacgatcgttatttcctagacgctttgtcaacacgtattttcgagttggatcgcgcaggtttgaccgagtaccagggaaattaccaggactatgttcgcctaaaggcggaacaggatgagcgcgacgcggctctacttcataaaaaggaacaactttataagcaagaattggcctggatgcgcagacaaccgcaggcgcgtgcgaccaagcagcaggctcgtatcaatcgtttccatgacttgaagaaagaagtttcaggtggtgctgctgagacagacttaaccataaactttgaaaccagtcggatcggtaaaaaagtcatcgagtttcaggatgtttcctttgcctatgaaaacaagcctattttgcaagattttaatctcttggtgcaggccaaagatcgtattggaatcgttggggacaacggtgttggaaaatcaaccctgcttaatctgattgcaggcagtcttgagccgacagcaggacaagttgtgattggggaaacagttcgcatcgcctatttctctcagcaaattgagggattggatgagagcaagcgagttatcaattacttgcaggaagtggcagaagaggtcaagaccagcggtggttctacgacttccattgcggaattgctggagcagttcctcttcccacgttcgacgcatggaaccttgattgagaaattgtctggtggagagaaaaaacgcctttatcttctcaaactgctccttgaaaaaccaaatgttcttctcttggacgagccaaccaatgacctagacattgcgaccttgacagttttggagaattttttgcaaggctttgcaggtcctgtcttgacagttagccatgaccgctatttcttggataaggtagcgaccaagattctagcttttgaggatggcaagattcgtccattctttggtcattatactgactaccttgatgaaaaggcctttgaaacagagatggccaatcaagtgcaaaaggctgaaaaagaaaaagtggtcaaggtgcgagaagagaagaaacgcatgacctaccaagaaaagcaggagtgggcaaacattgaaggcgatattgaagccttggaaaatcgtatcgctgcgattgaagaggaaatgcaggctaacggctctgactttggcaaactagcgactctccaaaaagaactggatgagaaaaacgaggcactccttgaaaaatacgaacgctatgaatacctaagtgaatttgatagctaggagaatagaaaaatcccgtctcatgacaggatttctctattcttttttgtttcttggtgaaagatattttgccaagtttcgtgacggcgccagatactggtatggacgataccatctaactcatagcagatgagtttggtcttttgactgatggaagtgatctgaatatccttgatagctgaattcaaatctttttcggctttataggcctctttatccatctgctctccatcctgacgaatatagacaaaatcgtcagctaagagttcttccagttgatttccttggtcaatcaattgttcacgcataagtaattttttatagacattgtctaaaatttcgtcctcagggataggtgctggctcgatatggacatcggtatcaaaaactccaaaacgctcttccagcatggattcgacctgatccgcaatctcatgactttcataaactgataagtcaggattcatttccagggtgatatcaagatagatattgctaccgtaggtacgacctctttgggacttgaccttgctgattttgggaatttccatgatagctttttggtagtcctcaagcagacggtcgtcgaaaccatctgaaaggctaaaggaagactcgatgaagatatcataggcagttttcaagataaagaaagtgatgatgatggcgaccagtttgtccacaataggataattgaaactgctagcaagaatggcaatggtcgtaccaagtgatgtaacagcatcagaaagattatccttggcagctgctttcagtgccttggagttggatttcttactgaggcgagtattgtagagatagactatgaacataatcgctgcagaaatgattcccagagttgcgcccagaggatcaatgaccgtttcttcccggctgagaatcttttgaatggtatcctgcagcacatcaaagccaacataaaacataatgatggaagtgattaagctagccaaatcttcaatcttccagtgaccaaaacggtggtcacggtctgcaggctggcgtgccattcgaatcccaatcaagagggccacatttccaatgatatcggatacgttattgaaaccatctgccaccaaactggatgaatgaagaaggtggccagttgctaatttggctgcagacaagagcaggtaggtcgaaatgctgataatggcaccacgttccgccaacttgagatttgaaatagattgcttcattcaacttcctttctagtcacatagcattctaccattatactggttttcaagggaaaattcaaataaggcattttttactctttgaaaatttttcaaaatttggtataatagtactactcaagggagtagctggcagaaacctgtgatagtgtcgtcattccgaattttatactgaaaagtatgttttccggccctatcttaaacagcgagacttgttatgattaacaggtctctttttgtttgtcgtgaaaagatacgatgaggaaaagagagtctgtttagcacacaatgtcaaggaggagacacatgtcaaaagaacaaaaacgccaagcgttttacactcaaagtcctgaagaggtcttgaaggctgtggatgcgaccgagcaaggtttgtcatcaagcgaggcagaaaaacgccttgccgaatttggccacaatgaactcgaagagggtgagaaacgatcaatcctggtcaaattcatcgaacagtttaaggatttgatgattatcatcctagttgcggcagctatcttgtcagtcgtgacttctggtggagaagatattgcagatgccatcattatcctagccgtggttatcatcaatgctgccttcggtgtttatcaagaaggaaaagcagaagaagctatcgaagccctcaaatccatgtcaagtccagctgcacgtgtccttcgtgatgggcatatggcggagattgactctaaagaattggtccctggagatatcgtttctcttgaagcaggtgacgtggtgccagcagacctacgtttgctagaagccaattctcttaaaatcgaagaagctgccttgacaggcgagtctgtgccagtcgaaaaagacttgacagtcgagcttgctgcagatgctggtattggtgaccgtgtcaatatggccttccaaaactcaaacgtgacctatggtcgtggaatgggtgttgttgttaatacaggtatgtacacagaagtcggtcatatcgcaggcatgcttcaagacgctgatgagacggatacacccctcaaacaaaacttgaacaatctttctaaggtcttgacctatgctatcttggttattgctcttgttacttttgtagtgggtgtcttcattcaagggaaaaatccacttggtgagttgatgacctctgttgcgcttgctgttgcagccatcccagaaggacttcctgctatcgtgaccatcgttcttgcccttggtacgcaagttttagccaaacgaaactctattgttcgtaagttgccagcagtagaaacccttggttcaactgaaatcatcgcttctgataagactggtacgctgaccatgaacaagatgaccgtcgaaaaagtcttctacgatgcaatcctacatgactcagctgatgatattgaactagggcttgaaatgccccttcttcgttcagttgtcttggccaatgatactaaaatagatgtggaaggcaacctgattggtgatccaaccgaaacagcctttatccagtatgccttggataagggttacgatgtcaaaggatttttagacaaatatcctcgtgtagctgaattgccatttgactctgaccgtaagctcatgtcaacggttcacccattgccagatggtaaattccttgtagcagtcaagggtgcgccagaccaactcttaaaacgttgtgttcttcgtgataaggctggggatattgctccgattgatgagaaagttacaaacctcattcatacaaacaattctgaaatggctcaccaagccttgcgtgtccttgctggtgcttataagattattgacagcattccagaaaacctcacttctgaagagcttgaaaatgatttaatctttactggtttgattgggatgattgaccctgaacgtcctgaggcagctgaggctgttcgtgtggctaaggaagcgggaattcgtccaatcatgattacgggtgatcaccaagacactgcagaagctattgccaaacgtttgggaatcattgatgcaaacgatacagaaggtcacgttttaactggtgctgagctcaacgaactgtcagatgaagactttgaaaaagtagttggtcaatactctgtttatgcccgtgtgtctccagaacacaaggttcgtatcgtcaaggcttggcaaaaacaaggtaaagtcgttgctatgacaggtgatggtgtcaatgatgcgccagctttgaaaacagcagacatcggtatcggtatgggaatcactggtacagaggtttctaagggggcatctgacatgattcttgcagatgataactttgcgaccatcatcgtcgcagttgaagaaggacgtaaggtcttctcaaacattcaaaagactattcagtatttgctttctgctaatactgctgaagtattgaccatcttcctatcaaccttgtttggttgggacgtcttgcagccagttcatcttttgtggatcaacttggtaacagataccttcccagctatcgctcttggtgttgaacctgctgagcctggtgtcatgaatcataaaccacgtggacgcaaggcaagcttcttctcaggtggtgttgtgagttctatcatctatcaaggtgtactccaagcagctattgttatgagtgtttatggacttgcgattgcttacccagttcatgtgggtgacaatcatgccattcatgcagatgccctaactatggcctttgcaacccttggcttgattcaactcttccatgcctacaatgtcaaatctgtttaccaatccatcttgacagttggtccattcaagtctaagacatttaactggtctatcttggtatccttcatccttctcatggcaacaatcgtcgtagaaccgcttgaaggaatcttccacgtaaccaaactagacttgtcacaatggggaatcgttatgggtggaagcttctcaatgattatcatcgtcgaaatcgttaaatttatccaacgtaaactcggttttgacaagaatgcgatttaaaaaaaagtcatcttcggatggcttttttaaataactttaaaaagaatagaaaaaactttaaaaaagagatgttaaatgtaatgccgcttactaaaatattaggtataagaatagtaaataataacttagggggaaatcatgggaagtaaaaaatgtatttactctatccgtaaattgagtttgggtgttgcttcagttgttgtggcttgtggtttaggttttttagctggctctgttgggagtgtatctgcagatgaaacgctcgcagctagtcatatcttagaaacagacaaaccttctagcgaaagcattgacaaggataagtctgtcgagggttcagaaaaagaagctactgcttcagaagagcaacattttgaagaaaaacatttagatactcctaaagtgactgaaaaggaatctcgtgttgaatttaattatattgatgaatcaacagggaaaaaacttttttcagatgagcgtactggtaaggtgggagaggatcttcactacgatacgagaaagaaaattagtgagttcaaatggaatggctatgtattggttgaagatggttatttgaaaacggatgaatcgaagaagctgtttcaagatgatcagactccgcaaacgtatactattaaattaactccaaaacatgaagtgattagcttacaaaaccagactaatcctaagtcaaatgaagaggtggaagctggtgttgtcgatagtcctaagtggcctgcagatgctgaaaagatcagaaccaatcaagaaaggcctttagagagaacgattcaaagaatcattaaatataaatataagaataatggtaaagaagcctttgctgagaaaaaacaaagtatttcctttgaacgctatgcgactgttaatcttgttactaaggaaatttcctattctaactggaaaataaaacaggagcatattaaaaatcaaacagccaagattagctatgtggatatcagtgaaaacaagctactgaaggaagatacagttactggggaatctggttatcctattgaatacagtacgctaaaaacgattagtgactacaagcgacaaggatacgatcttgtatcaagtgattatgatcgaggtttacaatattttgaccaagatagtaagactggtcaaatatttaaggttgctttaacccctcgcctagaatttatttatcctgaagatagaattccaactgctcataaaaaagttgatgaggatgttcaagattcacctttatggcctgccagtgtttctaaaatcgtcaataaaaaatctattgaccgaaacattgcttatcgagattttgtgacacatgataaggttgctgaagatcgaaatgatcaagttgatttcaaacgcgttgccaaggttgattttgtaagaggagacctttattatcgtgattggacgagtgatcaaccaaatctatctaaagtagcgacaccactgctaaaaggcttggtggcagataaagaagcagttgcagagaaaacagtggcagtaacagatcctgtaattagggaaactgtttactacaaacaattaggaaaatggatagccatttctccaactgcaaatgagaatgtggctttgattcaatatcccaatgaccaagatggtaatcctgctaaagcaggtcttgctagcaatccaggtttaggaacaatcccttatcttaaaggttataaggctgtgacatcagctactgatttggtgttgaaggattcttcgcatccagaattgggttacttattacctgaagtaccagaagattttacaaaagacacaataatcaattatctacctgtgaaagctactgagccagaaccaccaagaggtgatcaacccaagacgccagaagctccaacccctgaggagccaaagcacccagaagtaccgacggtagatcaacctaagaatcctgaaaaaccaacacctgaggaccctaaacagccgggagtgccgactgttgagcaaccaaaaactccagcaagtccagtacctgcggagccaaagcgccccgaagttccagctgttgctcaacctaaggttcccgaaaaaccatcccctaaggaacccaagcaacctgaagttccgactgctgagcaaccaaagactccagcaagtccagcgcctgaggagccaaagcacccagaaactccaataataagtgaaacaaaggaagctggtaaactaccagagacagctagtcatgattctattttgctagtagtcggattcttatcagccctatctggcgtcctattgtttaaagttaaaaaagattaagaatttacaaatagaaaaaaagtcatcttcggatggctttttgctacagtttagggaaagggcttgcagttatcggcttttgtgctataattgctataatatagtaaaaagtaagtggagtgtgaggaagtggagaagaaaattgtaaaggatattttgtttttatctcaggtgtctcagccggcaagtcaggaagacctttatcttgctagagatttgcaggatacgcttttagcaaatcgtgagacttgtgtcggtctggctgccaatatgattggggtgcagaagcgcgtgattatctttaatcttggcttggttcctgtggtcatgtttaacccagtgctcctgtcctctgaaggagtttatgagacagaggaaggttgtttgtccttgacaggtgtgagacctactaagcgttatgaaatcataagggttgcctattgtgacagcaagtggcaggaacagaccattactttgacaggcttcccggctcagatttgccagcatgaactggatcacttggaaggacgaatcatttaggaggaaagcaaatgaaacgaatagtctttgaacttatttttatcgcaacgacctggtatatctttttaccgcctcttaacctgaccagctgggaatttctctttttcctctgtgggcatttgctggttgtagcaatcttatttggctttggcaagggaatcaatctggtcaaaacggttcatgtgcgccacggaaaggcggaagctgccttaaatcttgagggtttcaaaatcaatcggttagggaaaatccttttagcttctattggaggaattcttctcttagcagccttggtttccttggtaacttctagcatttttcaggctaaaaattatgccaatgtagtcacggttacggaaaaagactttactgattttcctaagactgataccagtaaggttcctatcttagatagaagtaccgctgaaaaaattggggaccgctacttgggttccctaacagataaggtgtcgcagtacgtagcggcagatacctatacccaattgacaattgatgggaagccttatcgggttacaccactagaatacgcagatcctatcaagtggtttaataatcaggccaagggaatcggcgagtatatcaaggtagacatggtgactggaaatgcggacttggtggacttgaagacaccaatcaagtattcggattcggagtattttaaccgtgatgtcaagcgtcacctgcgcttgaagtacccaactaaaatcttcaagactccatcttttgaggtggacgatgaaggtaatcctttctatgtggctacggtttaccaaaagcaatttggacttgcggttccccgtcctgtttcagtcattatcttggatgctacaaatggagaaaccaaggaatacagcttatcagaagtcccagaatgggtagacagggtctatccagctgaggaaaccattgagcaaatcaactacaacggcaagtacaaggacggtttctggaatgctatgatttccaagaaaaacgtgacccagactaccaagggctataattacttgtctatcggcaatgacatctatctctacacaggtgtgacgtcggccaatgcagatgaaagtaatcttggttttatcctagaaaatatgcgaacaggagaaatcactaagtacagcttggcttctgcgaccgaagaatcagcccgtgaatcagccgaaggtgctgttcaggagaaatcctacaaggcaaccttcccaatcctcatcaacctcaatgacaagcctctctacatcatgggcttgaaggacaatgctggtttggtcaaagagtacgccttggttgatgcagtcgagtaccaaaatgttatcgtagctacgacagtggaagaactgctcagcaagtacgccaataaaaacgaccttgaaattgataatgaaacaacagaaagcattaagggtgtggtggcagacctcaaatcagctgttatcaagggcgacaccgtatatttctttaaagttgatggcaagatatacaaagtcaaggcctcagtctcagatgaccttccttaccttgaaaatggtaaaaccttcgaaggtcaagtaggaaaagacaactatctcaagacctttaaagtacagtaatactcttcgaaaatctcttcaaaccacgtcaacgtcgccttgccgtactcaagtacagcctgcggctagtttcctagtttgctctttgattttcattgagtataaaaaagctttatttaagaagtatatgttataataaggtaaattaagcctaatggaggacaaagaaatgggtttttatgtgatgcttgcttcaatgctactcggactgctcgctttgaagatargtttttctcagttcaaggagaaaaaagataaattcttatctatcttaacaagtttagctggcctagcccttgttctcgtggctgtctggttaggatggccaaaataaatagagaagcctcggtcaaaccgaggtttttcagatgaatttcttggtagtggcaaaaaaatatgctacactatcaatatgaaaattttaatcccaacagcaaaagaaatgaacacagacttgccaagtattgaagccactcctttaaaaccagaaagtcaggccgtgctggatgccttggctctctattctgttagtcaattggagagtttttacaaagtttcagccgagaaagctgtggcagaatttcaaaatatccaaactttaaaaaaacaaactgctcaacactatccagccttgaaactttttgatgggcttatgtaccgtcatatcaagcgagacaaactggacgaggcagaacaagcctatcttgaaaatcatgtcttcattacctcggccttgtacggtgttgttccagccttgtcacctatggcccctcaccgtttggactttttgatgaagttaaaagtcgctggtaagactttgaagagccattggaaggcagcctatgatgaggctatgaatggtgaagacctaattttctccctcttgtcgtcagagtttgaaactgtgttttctaaggaaatcagagaaaaaatggtgaccttcaaattcatggaggatagaggtggtcagctgaagattcactcaaccatttccaagaaagcgcgtggtgccttcctaacatctctaatagaaaatcaagtacaaactgtggaggaagcacgtcgcttgaactttgccggatttgcctaccgagaagatttgtcacaaccacaggaattggtttttgttaaggaagtttagaaatcagataagagaaaaagtcagcaggattatgctgacttttttctagcttataaagtattggacaaatgaatctcatttgataaagtattaagatgattaaccaaatccatgattgacagatgattttgacaaataaacttcttggtaattcctggaatatagaaattagacacgatgatatcataacctgtctgatttaaaatctcaggactcgtttccaattcatcccaagtatcgaaggtaaagcggttattacagtagtaggaaagcatatcaacaaaggtaagggatatagcatggtcaaaattactgataatcaaaaccttgataggtggtcgattttctaacaactgagtagagaggttttcagcatgggttaagatggtgtacatcaagtgttccaactgttcaggatggtcatgctgtccaattgcctgacgatattgggccagttcttgacgtgcacttcccataaagtctgggaagtaaacttcaaattttttaatcgtcaatgctttttgttcaaataagattggggtagaaaagatttcctgtctttcaaagaaagcagtgttgtgtaaatgccaaatcagctcatcgtggttagtaaaagtaatcttatattgttttgctaggcgttctaatatttgactaagtaattggtaagagtatcttgcttcactgttatcttctaaagagttgaagaattcttgaggatctaagaaaagattgttttgaataaaggatataaaaatttgggcaatgatatctggggtgatttccagtcccagtttttcagaaaaatggacaagtatctcctcaaagtttggaatactcatcaaaagagggtagtattcatcgtagaaatgatttggtaagtcgatgaaatgaccgtttttaatgcggtaaatactgatggctatcatcaatttgtacattctatagattgaaaatcgcattggataattcgtgatcttatagaagaagtcagtgaactctgttaaatcctcttcaggaaggtcaggaaaaggccagtctaggaaataatagcgctcagaaaaatattgggcaaaaaaatagcgaatatcgatttcattgccacgtatttcggatggagtaaatgatagttcaatttggaattgagttgacagagtttttgtaatatttctgcccaatcgatagaggttggcattactagagtgaagattttctatcgttcgataaataggtaacccctcattgaagaacatatactctagtaattgaaaagattgagaatgggcaagaaaatgttgatatacatcttccacgctagtctgcatatctaaatctatcataattccgttaatagaagattggatatcgatagttggaaaggcggtacgtaattcatttaaatcactttttagaattcgttctgtacatcctaaattgtcagcgagttcatgtaatctcatccaattacgattctggattaagatctccattaagcgtagttgtctttgagcttttgtggataaaaggttgcgcatgtaggtaatttcctccaaatttcattatatcatattattgtctaaagtgtacaaaaatgttggagtagaaaaagtgtctgaattagtcagaaaaattagaataatataagtggcttttaggtacaaaaagagaatatattaattacatagaaaatattgatttatatatcaaatagttgtagagtgagaactataaaatactatctaggagttcacaatgaaacattcacataaaaaatcatttgactggtatagcttgcaacaaagatactctattcgtaagtatcactttggtgcagcgagtgtcttgctcgggacggccttagtcttgggaactgctgccaatgcccaagcagtacaagcagaggaaaaaaatccagaagctactaacagtgtttctgttgataaggtagaagaagctaccaaaccagcagaagtttctacagctaagaaagaaacaacctatgcagctccaacggttgctaatccagtagaagtaactccagctaaatctgaagatgctaaagcaccagcagaaaaagttgaagaagcaaaagataaaaaagaagaagtaagtcatcaagatgctgttgacaagtcaaaattgttaacggctctttcgcgtgcagaaaaattggagcttaagttatatactgaagatagtgtaaaacgccttcaaaatagtatccaatctgctaaaggattattaaataaagcagatgtgacagagtcagaattatctcaagcagagtctgatcttcaagcagcagttatcgctttggaacttagagggacaactaaagttgctgataaagctgaagtagtgagtaaaattgaatcagttgaaacgaaaaatgctgaatcaaaagtaactgaacaaacttctaaggtagaaaaagataaaagcgccttaaaacctgttaaaggactccgagtagaagatgcaaaggccaataaagaaggcggatggaatattcccttagaccaagaagcccgcttgcaattaaagagtgctattgaagcccatgcagcacaatcacgttcacgtcgccggaaacgtgatattggagatttggactatactttcaagaaagttatgactccagtcaatccaggtcattatgcagatgctaagagtgtggatgagttaacagttaatccagattttacccctgagacagaaatcaacgtttggtataaggatttaggttatatcaatctagtcgataaaaatggacattacatcaattcaaatggtgaagtagtagaaaataaagaagcagctattcgtcgacaatataaaaacgactttaatgatacaacaagagcagatgtaactgaaattcctaatgcaccagttggttggaaaattagtgacaaccaatctattcgtggatatgatgcagaaacaaaaactattgatccaaacgacgataatgatttagatgctgttggtaaagattctaatgtagtcattgaaaaagaaaatcaaaaagctgttatccgttatgtaagcactaatggtaatcaagttctcaaaacagatgaagtgacaggtaagtcaggtgaagccattgcctacagcacaacaagtcaaatcaatgaattcaagaaacaaggctacaagcttgttagcgatgaattcacagcaggtggtgctaaggtttatgactatgatacagcacgtgaccaagtctacactgtaaccctttcagaacgtgttgaaccggttaacccagataacccaaatccacaaccaaatacaccagttaatccaggacaaccagatagcccacgttggccaggaaccgttgaaaacttggataacaaggaaagtgttagccgtactatccattatgtttatgaagatggaagtaaggctaaggatgatgtggttgaaacactgaacttcaaacgttggagtaatgtcaacttggtaacaggtcatatcgacttccaagactggacaactaatgatgatacgtttgataaagtagtctctccaactatcgcaggttacacagcggataaatcagaaatcccagctgtaagtggagttcaagcgaaagaccaagaccgtgttgaaacagtcacttatcataaggatgcccaaaaagctgttatccgttatgtaagcactaatggtaatcaagttctcaaaacagatgaagtaacaggtaagtcaggagaagccattgcctacagcactacaagtcaaatcacagagttcaagaaacaaggctacaagcttgttagcgatgaattcacagcaggtggtgctaaggtttatgactacgatacagcacgtgaccaagtctacactgtaaccctttcagaacgtgttgaaccggttaacccagataacccaagcccacaaccaaatacaccagtcaatccaggacaaccagatagcccacgttggccaggaaccgttgaaaacttggataacaaggaaagtgttagccgtactatccattacgtttatgaagacggaagtcaggctaaggatgatgtggttgaaacactgaacttcaaacgttggagtaatgtcaacttggtaacaggtcatattgacttccaagactggacaactaatgatgatacgtttgataaagtagtctctccaactatcgcaggttacacagcggataaatcagaaatcccagctgtaagtggagttcaagcgaaagaccaagaccgtgttgaaacagtcacttatcataaggatgcccaaaaagctgttatccgttatgtaagcactaatggtaatcaagttctcaaaacagatgaagtgacaggtaagtcaggtgaagccattgcctacagcactacaagtcaaatcacagaattcaagaaacaaggatataaccttgttagcgatgaattcacagcgggtggtgctaaggtttatgactatgatacagcacgtgaccaagtctacactgtaaccctttcagaacgtgttgaaccggttaacccagataacccaaatccacaaccaaatacaccagttaatccaggacaaccagatagcccacgttggccaggaaccgttgaaaacttggataacaaggaaagtgttagccgtactatccattacgtttatgaagacggaagtcaggctaaggatgatgtggttgaaacactgaacttcaaacgttggagcaatgtcaacttggtaacaggtcatattgacttccaagactggacaactaatgatgatacgtttgataaagtagtctctccaactatcgcaggttacacagcggataaatcagaaatcccagctgtaagtggagttcaagcgaaagaccaagaccgtgttgaaacagtcacttatcataaggatgcccaaaaagctgttatccgttatgtaagcactaatggtaatcaagttctcaaaacagatgaagtaacaggtaagtcaggagaagccattgcctacagcacaacaagtcaaatcacagagttcaagaaacaaggctacaagcttgttagcgatgaattcacagcaggtggtgctaaggtttatgactacgatacagcacgtgaccaagtctacactgtaaccctttcagaacgtgttgaaccggttaacccagataacccaagcccacaaccaaatacaccagttaatccaggacaaccagatagcccacgttggccaggaaccgttgaaaacttggataacaaggaaagtgttagccgtactatccattatgtttatgaagatggaagtaaggctaaggatgatgtggttgaaacactgaacttcaaacgttggagtaatgtcaacttggtaacaggtcatatcgacttccaagactggacaactaatgatgatacgtttgataaagtagtctctccaactatcgcaggttacacagcggataaatcagaaatcccagctgtaagtggagttcaagcgaaagaccaagaccgtgttgaaacagtcacttatcataaggatgcccaaaaagctgttatccgttatgtaagcactaatggtaatcaagttctcaaaacagatgaagtaacaggtaagtcaggtgaagccattgcctacagcactacaagtcaaatcacagaattcaagaaacaaggatataaccttgtcagcgatgaattcacagcgggtggtgctaaggtttatgactatgatacagcacgtgaccaagtctacactgtaaccctttcagaacgtgttgaaccggttaacccagataacccaagcccacaaccaaatacaccagtcaatccaggacaaccagatagtccacgttggccagctagtgtccatgatttagataacaaagaaagcgttagccgtactatccattacgtttatgaagatggaagtaaggctaaggatgatgtggttgaaacactgaacttcaaacgttggagtcgtattaacctagtgactggtcaaattttcttccaagactggacaactaatgatgatacgtttgataaagtagtctctccaactatcgcaggttacacagcagataaatcagaaatcccagctgtaagtggagttcaagcgaaagaccaagaccgtgttgaaacagtcacttatcataaggatgcccaaaaagctgttattcgctatgtaagcactaatggtaatcaagttctcaaaatagatgaagtgacaggtaagtcaggtgaagccattgcctacagcactacaagtcaaatcaatgaattcaagaaacaaggctatacgcttgtcagcgatgaattcacagcgggtggtgctaaggtttatgactatgatacagcacgtgaccaagtctacactgtaaccctttcagaacgtgttgaaccggttaacccagataacccaaatccacaaccaaatacaccagttaatccaggacaaccagatagcccacgttggccagctagtgtccatgatttggataacaaagaaagcgttagccgtaccatccattacgtttatgaagatggaagtaaggctaaggatgatgtggttgaaacactgaacttcaaacgttggagtcgtattaacctagtgactggtcaaattttcttccaagactggaccactaatgatgatacgtttgataaagtagtctctccaactatcgcaggttacacagcagataaatcagaaatcccagctgtaagtggagttcaagcgaaagatcaagaccgcgttgaaacagtcacttatcgtaaggatgcccaaaaagctgttatccgttacgtaagcactaacggcaatcatgttctcaaaacagatgaagtgacaggtaagtcaggcgaagccattgcttacagtacaacaagtcaaatcacagaattcaagaaacaaggctataaccttgttagtgatgaattcacagcgggtggtgcgaaggtttatgactacgatacagcacgtgaccaagtctacactgtaaccctttcagaacgtgtcgaacgtgtaacaccgaaagatcctaaaccacaacccaacacaccagtcaatccaggacaaccaaatacaccaaattggccaggtactgttgagagaatggagaaattgacccaaacaataagtcgtcgtattaatttccgttactacacaaatgggaaagctgcgtatggatcaattgatcaacatatcagttatgaacgaaatgcacttgtgaatttggtttctggtgatattaattatgaacaatggaagattaaggctattaagaaccaagacattgtagctccagtagcatctcaaccagctgtttcaactccaacggttgtcaacaatagtgaatcaagagttgctagatcatctagaagcagacgagcattgtcagaagtagctcctgttttagaaaatactttagctacacaagttcataattctcaagtgtctccattaggtttaactgtgacagaaaatggtgagcgttctgtacgccgttcatcaagaggtaaacgtgctgctgtagcggaatcaactacttcaaataattcagaagcggattcatctgttaatgctgtcttcaaagctgtacgaactcctattacaccaaaatactatgctactgtgaataaagtagggacgatggaggttaatccaaattctcctcaagatacagaagttaatgttgacttgaaagaaatgggacgcattgttgcagttaatgaaaaaggtcaatatataaatgccgaaggtgaggtcgttaaaaatattgacgatgcactatataagtattatgataacgatcctaatgacgctactagagcaggcattacaaagataccagatgcaccacatttttatgctttccataaagaacaaccaaatgtctggggatatagcataacggatagaacagttgatccaaatgatgattcagatcctgaccgtatcggtaagaatacattaatttcttatgatgcaattattgatccagtgtctaaggaaacaaaccaaacggtaagctttactggtgcaggttctgaaactcctaaagataatgttcaaaatgactttgtcttcaaggggtcatataatgaagcaactaaagaaacaacttgggaaaacaagaaccatacctatggaacagttaaagtaccagttgtgacaggatattttgctgataaagcagaagctggtgctaagacagttacgccagattcaccaaaagcaacagatacagttacatataaagctttgggtaaaatcattccagtagatgcttctggaaatgtgattgcaaatgctcctcaaccacaatacctgaatgatgcaaatgatcctcgtaaagctggagaaacagcagtacctgaaattgtaggctacaaaccagagcgtacaagtgttacacctgaaaatccaggtgaagatacaaaggtaacttacgtcaagacagatcaagttgcagtagttcgttatatagatatggataataaggatgaggtcgttcatacagacaatattactggtaaatctggagaaaagattgcctatacgacagaaactgttttgaaatcgttgattgaaaaagggtacttattgaaggaagatggtttccctacagatgcaacttttgatacagatgaaacaaaagttcaagaatatacagttctattgaaacataagattactgttaaaaaagatactccaaaacttgtggaaagaacgattcattatgtatttgcagatggtacaaaagcaagtgaagatcaccatgatcaagtaagcttttcacgtatgttaagtatcgataatgtaacaggtaaaactacaagtacatcttgggtttctgaagatggggtaacaagttttgacgaagtgatatctccaagcattgcaggatacaatcctgatcttgctaaggtagattcggttcaaggaattacagcagaaactgaaaatcaagttgtaactgtaacttatagaaatgttcaaccaattccacaagttacaccaactccaattccgactccaaccccaaccccacaagttacgccggatccagtaccgactccaactccaactccggttccaaccccggtaccgactccaactccacaggttatgccgtcaccaaccccaaatccaactccagttccaactccaaccccggctccacatgtgccgtcagaagttccaaaccaaactccagttgctagagagaatgaaaaagaacttcctaaaactgcaggtcactcttctggtatggctcatgttctgggagtatttggcttaattgctggatttagtttagttggaaaagcaaaaagagatgaataaaatcaaaacaaaactctaggcaacaaaatattgtaagtgtagtgttttagggagtgagaatgtatgtcaatacagcatcaattccactcccttttttatcataaaatagttagagagaaaaaatatgtattcaagagtaaaacggaatcaaatgaataaggtaaacaagtattccattagaaaatcaagttttggtgcagtatctgttgctgtagctgccttgatggtttttggtgcttattcaggtgtgagtgcagatgaacagaaagtagattcacatcgaactgaaaaagaggaacaaaaagtctctgaaaaacctgacgagactaagcaaaaaaattcagaggaaaaaatagcagaattgccttccgctcttcaaactccagttttggaaaaagaagaattagatgtcaatgcccttctaaagaaagaagcagaatctaaagtggcagctgagacaaaaaatgctgactcaaaagaattaacttctaaagaagtaaaacctagcgaagaaaaaactacttcacctgcttcaagtgaaaaggtaaatgaagaaaaatcagtcgaaaaaactactctggatcaggttgtatcagaagcagaagttttaaatcaagtcgctttacgttattctcaagaagcagaacgtaaagctgaagaaaaagccttagttcaagccgctgttaagacagccaccattcagatttcacaatcaaaagccttattaaaagattcatctgttagtgcagaaaatcttaagactcaattaaatcaactgtattcagctatcgaaacagtgtatactgagttgcaacgtgcaggacatggcaagaaaattagcgctagtctatcgccaattcaaacacaagatgtagctatcgataatggaaatattattgccaatggtacaatcgatatggcggaccgtgtgacttcaacaggtattgctgattatcgtttccaattaaaatttaaaaatggtgcctatcataagggggatatcttcacaattggcttgaaggaattaccacaagacaataatcttcctcaaaaattggttgctgaaggtaaagtatttgcagaacgagtgagtctgattcagaaaaatgataatgccaaagctggaagcctttcatactgggcttcacgtggagatcgtgacgttgctttggacactaaagaatcatgggatttagttgacaaaggaagtcatattgaagcaacataccgtttcactgacgaaattgaacgcttagacgatgttacttttgaacttcaatacagaggtggaattcgttatcctagagtgaatgtggataagtctgtaactggtgttatctcagttaatggtcaaaatgtagtcactaagaattacactgtgattaaaacagatatcggagcacctaaagtttatgatacacctactacagctaacttcacaggtgatgtgatgttggatgatgatggaagtatcaagacatacaacagtacccttcgtatcggaacatggaaatcaaactttagtgcagggactcgtttcactgttcgtattaaagatacagaattcaataagtttgctactgttggtgaatttattgagcgtggtgcccacaatgtcgaaatgataaatactagccctgatacatcaagaacaagggtaaatcgccataatgttatcttggaagcacctcgtgaagagcctggtcaacatgccaaattcaagattcttaaggcagcagataatgaattaacctttgaattggtatctggaaagatgttggctggaagaacttatgtattacgtacaaaagattttggagttgatcgtgttccgacaagtcacacagttaattatctgaatgaagctagaaatggttttaaatcgaatgttccagggacattgacagtggttgatgccaaaggtaaaaatcttacagaccaatacgaacaagctgctgattctgactggaaaattgctaacccagatatggttagaacagatggacgccttgtatatggagatgtagctgttcgcttcgttgatactcaagggaaaatgcttcttcctgccattgcagcggtggaaaatggaggtatccttcaagacaaattcactactgtaagaccatctaccaaaattgatactagctatgtagctactttggagagaaatacaactgagacagaagttcaagaaaacaaaggaattcaaacaacatctatcacagcaccttatttattgcattcaccaaatggtaaatattatgtcttcaaagagtatgcacagaatgatcgtttctatagcaatacgaagacatctggtacgattacacgagctcaagccaacgtggtagctgtgtacgaagaagctaaatttggtaaagttgatattcagtatcgtgataaaacaagtcaagctattttagaaacattcaatacaccacatgataagagttcaaatctcattaacttgttgggaaataactatgatgtgactgctaaagttcctgaacgtttcgaaaaagatggtgtagtatatgtcttgtcacaaacacctgctaatagtaagggacatttgacacaggctgatatccatgttgtttatgattatcttgctcaacaaaaagcacaggttaaatacctcaatcaaacagaaacaagtcctaaagttttaggaaatgtggatagtgtagttggtcttccaggtgaaacaattgcttataattcaaaaactcgtattaatcaatacctaaaacaaggatatgaattagtacatgacggttttgcaaatgctaatgataaacgctttgacagtgaaaaacaaactgatcaagtattctcagttcaattaatcgaaaaagttatgactgtcacagcagatgatcctaaaccaattgctggaaatccattggtagcaggagatgcattgtcacctgtttggcctaaatcggttgaaaacttagatacactgagaaaaatgaccaagcagaccattcactacaaatatctaaaagatggtaaaaaagctttcaaagatgtagttcgatctgtagtttttgaaagagtggcgagagttaacctcgttactggtgcagttatttatgataattggaaaatcacaagaattgatgataaaccagtagcgtcagtggatacgactgttcataaaccaaatgtcactccacaaggagtaacaactattgcagcaactccttctagtctagggaatggaatttctatcaaaccagttttgactgttccgaatccagttgttgcatcatcaccaattgttgcaaaacccgttgtaccggtcaagccagtaacaccggttaaaccagcagtgtcaactccggccaagccagcgcctgtcgttaaaccaaaaccggtagcaccagtaacacctgtcaaaccagtagtttcgacaccagtaactccagcgcctgttgccacaccacaaccagttgctccagtgaaaccagtagcacctgcaccggtaacacctgttaaaccagtagtatctactccagctacaccaacaccagctgtgcaaccaaagccggtagcgactactgattcaaaacctagcttaactccagctgaagccttggctgcaattaaaccaacagatttttcttcacaaacatctgttaataagaaaacagagacaacacctgttcctggtggaacggctacgactacaactacaacgacaaccactgttacctcaaatgcggcaacagcaggtccaacaacaccgattgtcactatcacgacaaatgagaccgaaactcattcagaggtgacaagtgtcattcatactggtactaccagccacacgcatgtagtcggagttgttacaaaaccaaatgtagttgttactcatccaaaaccaagtgttcagcctaaaccgcatttaacgagacctcatcatggaccagtacaccatgttccttcacgtccaggtaaacaagttaaaccaattagaactggaccaggaactcgtggtcatgctagaagacatcgctaaatataaagtgttaatactgatttaactagtaggatagtataatctaaataaaatagagtttataaaaatgagtaacttaatataaaagttgctcattttttgataataaaatgaatttagtaattttctggattagtaaattatttttacaaaaatataacaaatcttataaacaatatattatgtatcgaaagggtttgcatataaggaaataaaagaatataatatatacaagaagtaattttataatttgaagcaaggagttcttaatgttttttaatcgaaaaggaatcaatcaaaagaattggcggatgataaagaaagggaagcattttctttttgggtgcactctttttttggctaccggagcagtgacgatacagaatccacatcttgttcatgctgatgaaatggttgcgtctctgaatgattcaactaaagttaaagatgaagatccgaatagtgacaagattccaaacgatgtggaaaatcatccacaggtagaaaatcctgttaaagaatcagataagatttctgaacatgttccagaagaaaaaattcttgaaaagtctttagagcatccagtcaaagctgtggataaaactgctttaaatgaattaattgaaaagattaggaacactgatttacagactaaaacagctaaatcagttgaaaatcttaatctctctttgtcgcgtgcgcaagcagtcttggataaagaaggtgctagtcaggatgagatagataaagaagttcaagctttgtctgaatcatttgctcaactggaagagaaaagcaacgacatagacaaaaaagaaaagcaagcagacaaagcaaacgatagtgatgaaaagaaaaatccttcaacagaaaagatcgctaaggttcaggctcttgtttcagaaattaaccaactggcaggagaaatcagttatgaattcagtgaatctgaaagcaaatctcttcaagtatttgcagatttatctgagggaaaagccactgagagtgaagttgatggtgctctaaatgaagcgaagagcctccgcaacaaagtagctaatagagtaactcgagcacaatctgggaaacgtgatccacggaatggaaaaccaattgatggtaagggagagagtgggtttagagctatttggatatcgtcaattgctaacaaatacgagggtagtaatgcgttagtaaacgaaaataaaaaagaattaactttttataattcagatactctattctcggtaatgacagcatatggtaaaagaggaaatggagagccattagtaagatatccgaatggccctaaacgtggagaggaagatcctactccgtattatgtaaaaagagtaggagttataagtggtcttaatcaagttaaaggtttaaaactacgtgtagcttataaaaatttccaaacaggaaagaaagaagaagtagatattgctgctaactattggaatgtaaataatcctgaagtgcaaatggctcttgttggaactataggtgatggtggaaatgtaacaccaggtacttatcatattacaattggagcaaatgggacacataaacaaaatacaattacctatactttgactatcaaacctcaaagtgaacgtaatactgttagagatttaacgccaacttatgtggatgatgtccgtcatttaacggaaacagaaaaaaatgctttgattgaaaaatttaaagcagagcatccaaatgtggttaatcgtgcgaatcatatcgactttgaccatgctgaggtatcagctgatggtgcaacaatgacgattcattttaaagatggattcaaccctaaaaccattcaaacaaatgcgacaaatgatgtagaagcgaaacattccagtttgactgcttattttggggattcaaaagaattatatacgaatccaagagaattagtacgatcaaaaacaggacatgaagtaccaacaacggctcaggtaacgtataaaacaccatttaacttgcaagaagcagggacaagaaatgttgttgtcacaacaacttatgaaaatggagtaacaaaagatgtaacaactccttatacagttttagattttctaggaaaacaagataaaaaaattaatcagaatcagtctggtcaactaggggatgctagaaattacgtgacagtttcagataattcagcagttccaggagaattaacagttcgttggaaaggtggctcttctaatgtggatacctctgcagcaggtgtacaacataaagaaatcgaaattcttcgtggtagtcatttaatgaaaactgtgaatgtcccagttgagattgtagataatattaaaccgacaattactgcccctgataatattacattaacgagattagaaggactacctagtgaaatcaatattcacgctcaagataatgataaaggagtaggtctcaaagaaagtaactctgtaacggttgacaatctaccgaatccattatcttacaatgcaaaaaaatcaaaaattgaaattaatggcgttattccaaataatttccaacttggtaaatcaagtattcaagtgactgttaaagcggttgataaaaaagaaaatactgcgactaaaaatattactttccatattcaatctcaaacacaaaaatatacagcagttgctaattctcaaattcaagaagtgagttatggggaagcgcctgatgcaggaacaagtattcaaaaaaatgggctgccaacaggtacaagatacggatgggcaacacaacctaatacggcaacaggccctggggatcaaaccgaagtcgtaactgtaacctatccagatggctcaacagatacagtacctgtaaccgtgaaagtccgtaaactaagtgatgaacatataccaactggaaagacaattactgtgaatcaaaatgatccagtaacgaatgatagattaaaagcagcagtaacagtggataatggtggaactagaaaagtcaagtcagttactgcagcgcctataagcactgtgcatgcaggctcacaaaccataaaagcgacagtaacttatctggataataccactgatccagttgatattcctctagaagtaaaagacgtaattgctccaacaattcaaacaccaacagaaggtcaaacatgggaaatcacagcattagataagacattgccacctattaaagtagcagttgctgataatcctggaggaagtggaataaagagtattgttccaatgaacttaccaagtttcttgaagtatgataaagcgacaagtagcatcgttttccaagatggagaacgtgaagttccaaaattgtctggaagaactcgaactacaagaaatataacattacgtgtggaagataatgcaggaaatagtagtgaacgaacatttagtattactcacatgcctatggctgaaaagtataatccacaagcgaatgcaacgattcaagaagtgagccatggtgaaactcctaatccgaaaacaagtgtgaatacagcaggattaccgactgatgctcaatatacatggaaatctgcaccagatacgaatagacctggaaataaaacaggagtcgtgaaagttacttatccagacgattcagtagatgaagtaacggttactgtaaaagttcgtaagctaagtgatgagtatgaacctacagctacaaaaattgtcaaaaatcaaaacgatactgtctcagaacaagacttaaaatctgctgtgacaattaataaaaacggtaatagtaaggtgaaaactgttactcctgttgggaaaattagtactgctgagacagggaacaaagaaatttcagcaacggtaacctatctcgatgatacaagggatacggtaacaattcctttagaagtaaaagatgtaacggctccaacgattcaaacaccagcgaatggtcagaatatcgatttaatagcattagataaagcattttctccaattaaagtaacatctgaagacaatgcaggaggaagtggtgttcggtcaacaacggtaacagacttaccagatttcttaacttatgatgatgcgaataaaaccattaagtttaaagatggtactcaagaagttccaaaattaccagttggtacagattctcaaacacatacagctacaattcgagtgacagataatgcgaataatagtagtacttcacaattaacgtttactgtgaaatcaatgactaccaaatatgatgcaacagcaaatccgaacaaacaaacagtgagttatggggcaactccagatgcaggaacaagcgtgaatcaaacaggcttaccggaagggacaagttatgcttggaaaacaccaccagtaacgaccgatgggcctggagaaaaagatggtgtagtagaagtaaagtataaagacggttcgaaagatatcgtaaatgtaaaagttactgtaaaaggacttagctcagaatacgaagtaactggaacgctaattgaagtaaatcaaaatgattcagtttcaaatgacgacttaaaagcgaaagtaactgcaacttcaaaagcaggaaatgtgaatggaacagataagatttcaacagttacagcacctacaatcagcacagctaactatggtgaacaaactattaacgctacagtaactttcaaagatggaacaactaaagaagtgaccattcctctgaaagttaaagacgtgacaccaccaacaatccaatcaccagcagaaaatacaaactgggaaatgacagcattagacaaagctttaccaaatatggaagtaagagcggaagataatgaaaacggaagtggaattaaaaacgttactgtgacaggcttgcctgattacttagaatatgatagtacaactaacgctattaaattcaaatcaggaaaacaaacagtagaaaaactagctgagaatacaccaagtcaagaatttactttaaacattcgagcagaagacaaagcaggaaatgtcagcgaaagaactgcgaaaatcactgtatcttcaatgagtaccaagaatactccaacgccaatttcacaaaatacaagttatggacaagtgccagatcctaataaaagtgtagataaagcaggcttaccagaaggcacaaccgtcacatggaaagaaactccagttgtgaatacaccaggaagtcatccaggagtagccttagttcattatccagatggaacggaagatgaagtagaagtaccagtcacagttaagaaacaaagtgacaccttcaacccaacggcaaaagaaccgaaccaaactgtgcgtcacaacgaagtaccagatccagagaaaagtattaatacaaacgacttaccaaaaggaacaaactatagctggtcagaacaaccagacacaagtaaaccaggaagtaagacaggaaaagtattaatcacttacccagataagagtacggaagaagtgacggtaacggtaaacgtaacgcctcaaaatgatgaatacacaccaactggaatccctcaagaagtggacaatggacacgtaccagatccagaaacaagtgtaaccaaaaccggcttaccagaaggcacaactgttacatggaagacaaggccagatgtcagcacaccgggcagtcatccaggagtagcgttagttcattatccagatggaacggaagatgaagtcgaagtaccagtaagggtaaaagaacaaaaagataccttcaacccaacggcaaaagaaccgaaccaaactgtgcgtcacaacgaagtaccagatccagagaaaagtattaatacaaacgacttaccaaaaggaacaaactatagctggtccgaacaaccagacacaagtaaaccaggaagtaagacaggaaaagtattaatcacttacccagataagagtacggaagaagtgacggtaacggtaaacgtaacgcctcaaaatgatgaatacacaccaactggaatccctcaagaagtggacaatggacacgtaccagatccagaaacaagtgtaaccaaaaccggcttaccagaaggcacaactgttacatggaagacaaggccagatgtcagcacaccaggcagtcatccaggagtagccttagttcattatccagatggaacggaagatgaagtagaaattcctgtcacagttaagaaacaaagtgacaccttcaacccaacggcaaaagaaccgaaccaaactgttcgtcacaacgaagtaccagatccagagaaaagtattaatacaaatgacttaccaaaaggaacaaactatagctggtcagaacaaccagacacaagtaaaccaggaagtaagacaggaaaagtattaatcacctatccagaccatagtacggaagaagtgacggtaacggtaaacgtaactccacaaaatgatgaatacagcccaactggtattgcgcaaaccgtagacaatggacatgtgccagatccagaaacaagtgtaaacaaaacaggcttaccagaaggcacaaccgtcacatggaaagaaactccagttgtgaatacaccaggaagtcatccaggagtagccttagttcattatccagatggaacggaagatgaagtagaagtaccagtcacagttaagaaacaaagtgacaccttcaacccaacggcaaaagaaccgaaccaaactgttcgtcacaacgaagtaccagatccagagaaaagtattaatacaaacgacttaccaaaaggaacaaactatagctggtcagaacaaccagacacaagtaaaccaggaagtaagacaggaaaagtattaatcacttacccagataagagtacggaagaagtgacggtaacggtaaacgtaacgcctcaaaatgatgaatacacaccaactggaatccctcaagaagtggacaatggacacgtaccagatccagaaacaagtgtaaccaaaaccggcttaccagaaggcacaactgttacatggaagacaaggccagatgtcagcacaccgggcagtcatccaggagtagcgttagttcattatccagatggaacggaagatgaagtcgaagtaccagtaagggtaaaagaacaaaaagataccttcaacccaacggcaaaagaaccgaaccaaactgtgcgtcacaacgaagtaccagatccagagaaaagtattaatacaaacgacttaccaaaaggaacaaactatagctggtccgaacaaccagacacaagtaaaccaggaagtaagacaggaaaagtattaatcacttacccagataagagtacggaagaagtgacggtaacggtaaacgtaacgcctcaaaatgatgaatacacaccaactggaatccctcaagaagtggacaatggacacgtaccagatccagaaacaagtgtaaccaaaaccggcttaccagaaggcacaactgttacatggaagacaaggccagatgtcagcacaccaggcagtcatccaggagtagccttagttcattatccagatggaacggaagatgaagtagaaattcctgtcacagttaagaaacaaagtgacaccttcaacccaacggcaaaagaaccgaaccaaactgttcgtcacaacgaagtaccagatccagagaaaagtattaatacaaatgacttaccaaaaggaacaaactatagctggtcagaacaaccagacacaagtaaaccaggaagtaagacaggaaaagtattaatcacctatccagaccatagtacggaagaagtgacggtaacggtaaacgtaactccacaaaatgatgaatacagcccaactggtattgcgcaaaccgtagacaatggacatgtgccagatccagaaacaagtgtaaacaaaacaggcttaccagaaggcacaaccgtcacatggaaagaaactccagttgtgaatacaccaggaagtcatccaggagtagccttagttcattatccagatggaacggaagatgaagtagaagtaccagtcacagttaagaaacaaagtgacaccttcaacccaacggcaaaagaaccgaaccaaactgttcgtcacaacgaagtaccagatccagagaaaagtattaatacaaacgacttaccaaaaggaacaaactatagctggtcagaacaaccagacacaagtaaaccaggaagtaagacaggaaaagtattaatcacttacccagataagagtacggaagaagtgacggtaacggtaaacgtaacgcctcaaaatgatgaatacacaccaactggaatccctcaagaagtggacaatggacacgtaccagatccagaaacaagtgtaaccaaaaccggcttaccagaaggcacaactgttacatggaagacaaggccagatgtcagcacaccgggcagtcatccaggagtagcgttagttcattatccagatggaacggaagatgaagtcgaagtaccagtaagggtaaaagaacaaaaagataccttcaacccaacggcaaaagaaccgaaccaaactgttcgtcacaacgaagtaccagatccagagaaaagtattaatacaaatgacttaccaaaaggaacaaactatagctggtcagaacaaccagacacaagtaaaccaggaagtaagacaggaaaagtattaatcacttacccagataagagtacggaagaagtgacggtaacagtcgaagtaacgccacaaaaagacgattacgatccacagccaaaaacacaaacggtagaacatgctcaagtaccatctgcaaaagatagtattgaaaatgtaaaaacgttaccagaaggaacgacttttggatggaaagatggaaaaattccagatacttcaaaacatggggagaaaaaaggtgttgtaactgtaacgtatccagatggaagtacagaagatgttgatgttgtaatcactgtgaatccagaagatttcagtccagtagttccgatggagaaagtaccagtgaaaaatcctgagaacttaagtccagaagaacaagataaagtgaaagaaaaagtgacaaaagcaaatccaggaaaagacgtaacagttgattcaaaaggaaatgtaacaattacagatccggagacaaaagtaagtcatgaaatttctcgagataaattagtttttgcatatgcaaaaggtgaaccagaaacttcgaaaatccctgaatttaatggcggagtgaacgcaccagattcgccagttcatgaagttccagagtttgcaggtggagtaaatggtgagccagaaattcaagaaaccttaccggaatttaatggcggagtgaacgcaccaaattcaccaacacatgaagtcccagaattcaatggaggtgtaaatggtgagcttcctgatccagtagaagtatctaaaattcaactgatgatcaccaagtgggttgatgaaaatggaaaagaattgaaaccagcggatgccaaagcaccaaaggtattaggtgaagccaatgaagcatttgaacatggtgaaattgaagggtatgtatttgtaagaacagaaactaaaggtgatgttgtaactcacatcttcaggaaagtgagtccagtcagaccaacaggtgacggtcaacaaagaccagctacaccatctgatgatacaaatcctagaccggatattgctacccctactgaggtgccagctactcaagcggctggacaaccaagtcaaatagttgcaatgcctgctcaattgcagaatgaagtgtcagaaacgaatccatccgtttctcaaactcaagcagtattgccaaatactggtatacaagaagaccgtactacaggtacagtaggagttctctctcttcttggcgcatttggtttgctatttgccaaaaagaaaaaagacgatgaagaggaagcttaaatagatgatctcatctgatccttggtagctttccctacatgaagtctttgtaaatcaaaaagaactagaaacatcactcatttgtgagaactctagttcttttttcgtatttcaagaagtagtcattcaattgttgataaattgactagttttttgatatataggactaaaagtctgtttaaaaataacgattagtgatgactagatcgcattgaccaaatcttgagcttgtttttcaagtgagtttaggactgtttcttcaagaaccaattttccgtctgcccaagcagagtcattaacacgtgcagcagtgaaatcaccaacgatttgcgtacggataaatggcaagaggtccttgtaaatagcgaaaagttgatcgtgaccggcattagctacagatgatactgtgacaaacttgtcttgaagggcagaagcaccacgtgtatcagataagtcaagggcacgagatagccagtcaagcaagtttttcactgtaccagggatagagaagttgtagactggagagaagatccagatagcatccgcagcgagaactgcttcacgagcagctgctacagctgggtgagttggaacttctaaatcttgactgaagagagggacagctgaataatcaagatagctaacttctgctttaccagcaagtgctttctcagcttcgagcgccatttggtggttgaaagaaccttggcgaagagatccgacgataaataatacttttttagacatgatgtgtctcctttttcttaaatttccgagaagtctctcgttgttacggaatatattacaacaaaacaaaaggacttgcaagaaatttgctcagagtttatttgaaaattataaaattgctgaaacttagtcacgtgctactggaaaagtaagaactgttttttggattctggtttgctttgaagtaagaaatagaattggttgcttatactcaatgaaaatcaaagagcaaactaggaagctagccgcaggttgtactggagtacggcaaggcgaagctgacgtggtttgaatttgattttcgaagagtattcttatattcacttgtaataaagtttaatagatggtaaaatagacgagtgaaaaaaagacaaaacaaagcaaaaaataatctactgtggcagtatggtctagggatgacgattttgcttgtggttatcagtgcttcctttctgtatctagtgtttctgagtatgaaaccttatcaaacagctaaaagtgaaggagaaaaattagctcagcagtatgcaggattagagcaggctgatcaggttgacttatacaatggcttggaatcctattatagcattcttggtcgtaataaaaaacaagaagcacttgctgtcctgattggaaaagatgaccataagatttacgtttatcaactaaatcagggtatttcacaagaaaaagcggaagccgtttctaaggaaaaaggagctggcgagattgacaagattacctttggccgttatcaagacaagccaatttgggaagtcaagtcaggctctgatttttatctagtagattttgaaacaggagcattggtcaataaggagggcctatgaaactatccaaccgtgttttagaaatggaagaaagtgtgaccttggctgctggagcccgtgctaaagcactcaaggctgagggaagagatattttgtctctaaccttgggtgagccagatttcactactccaaaaaatatccaagatgccgccattgcatcgattcaagatgggcgtgcttctttttatacagtgacctcaggtctgccagagctcaaggcagcggtcaatacctactttgagcgcttttatggctattctgtagcgccaaatcaagtgacagtcgctgctggagccaaatattctctctataccttctttatggcagtggtcaatccaggtgatgaagtgatcatcccaaccccatactgggtcagctatggagaccaggtcaagatggcagagggtgtgccagtctttgtccctgctaaagaggacaatcactttaaggtgaccgtagagcagctagaagcagctcgcacagataagaccaaggttttggtgctgaattcgccatccaatccgacaggtatgatttacacccgtgaggagctcttggcaatcgggaactgggctgtagaaaaggatattctcatcctagcagatgatatttatggccgtttggtttataatggccatgagtttacagccatttctagcttatctgaagcgattcgcaagcaaacagtggtcatcaatggtgtgtctaaaacctatgctatgactggttggcggattggctatgccgttggagaagcagacattatcgctgccatgtccaagattgcaggtcaaacaacttcaaacccttcagcagtagcccagtatgcagcagttgaggctctatcaggtgagcaagatactgtagaaagcatgcgtcaggcttttgaggaacgactcaataccatctatcccctacttgctgaggtgcctggatttgaagtggtcaaaccacaaggagccttctacctcttcccaaatgtcaaaaaggccatggagatgaaaggctatacggatgtgacagactttacaaccgctatcctagaagaagctgaagtagccttggtaacaggagctggatttggagcgccagaaaatgtgcgcctcagctatgcgacagacctagatacgcttaaagaagcagttaaacgcttgaaagaatttatggaaaaataaaagaaaaagaaaaggaaaaataatgacaaaacgtgtaacgattattgatgtaaaagactatgttggtcaagaagtgacgattggtgcttgggttgccaataaatcaggaaaaggaaaaatcgccttcttgcaattgcgtgatggaacagccttcttccaaggtgtagcctttaaaccaaactttgtagaaaaatttggtgaagaagtgggacttgagaagtttgatatcatcaaacgcttgagccaagaaacttctgtttatgtgacagggattgtcaaagaagacgaacgttctaaatttggttatgagttggacattacagacatcgaagtgattggtgaatctcaagactacccaattacaccaaaagaacacggaacagacttcttgatggacaaccgtcacttgtggcttcgttctcgtaagcaagtagcggtgatgcaaatccgtaacgctattatctatgcaacttatgagttctttgacaagaacggtttcatgaaatttgatagcccaattctttcaggaaatgcggcagaagattcaacagaactctttgaaacagactacttcggaactccagcctacttgagccaatcaggtcagctttacttggaagcaggagctatggcccttggtcgtgtattcgactttggtccagtattccgtgctgaaaaatcaaaaacacgccgtcacttgactgagttctggatgatggacgcagagtactcatacttgacacacgatgagtcacttgacttgcaagaagcttatgtaaaagctcttctacaaggtgttcttgaccgtgcgcctcaagccttggaaacattggaacgtgatacagagctcttgaaacgctacattgcagagcccttcaaacgtatcacttacgatcaagccattgacctcttgcaagagcatgagaatgatgaagacgctgactacgaacatcttgagcatggagatgactttggttcaccgcatgaaacttggatctcaaaccactttggtgtgccaacatttgtcatgaactatccagcagccatcaaggccttctacatgaaaccagttcctggaaatccagagcgcgtgctttgtgcagacttgcttgctccagaaggttatggagaaatcatcggtggttctatgcgtgaggaagactacgatgcccttgttgctaagatggatgaacttggtatggaccgtacagagtatgaattctaccttgaccttcgtaaatacggtacagttccacacggtggatttggtatcggtattgagcgtatggtaacattcgcagcaggtacaaaacacatccgtgaagccattccattcccacgtatgttgcaccgtatcaaaccgtaaaaataaaataaaaaagttattataataaaaagaaggtaaatcccttctttttttgaactttgggtacaaaaataatgtacaaaaaacgagaatatatagagctttttgattgactaattttaaaaatatatggtagaatcgggttatgaatattgtgttgttgtttcgttaaagaaggtgttctttagcaggaaaggcagggaatatgaagaactccaaccttattctaaatcaacatatatataaaaaaggagaaaaaatgtattcaagaatggagaaataccatggtagaagagctcagcgcttttctattcgtaagtatagctttggtgccgctagtgttctattgggaactgctcttcttttaggagcaaatgctgttaaagctgatgaaacaagtactgcttctacaaaaacttcagaagttacaaattctgataaacagaaacctgattcagccataacaacaccagttgtggaggaacttccagaattaaaaattgatgctgtaaaagcagatgaaaaacctgaagttaaagaagaagctaaacctgtagcagaaaaagaagttaccgataaagctgcaacagaaaaatctgataaagagcaagctgacaaaaaagaagtagctaaagaaaaaactgacaaagaatcacctaaaaaagctgcaacagaaaaagcacaagatgaagtgaagacagttcttacccaattgacttcagaagctgaggttatggcatctgtagcttcaaacttctcagataaagaagtgaaagatgaagctgccaaaaaagaacttgcggttacgattgaggcagttaaactggaagcagcgaagtctaacgatttgctttcatccgatgcttctaaagaccaaatggtagcccaagtgaatcgtctttctgctgccattgaagcagtttatacggaaatgaaacgtgcaggtcatgcaggtaaagtagaatcggtattagctgctactgcgtcaaaaattacaggtaaagacgttcttaaagatggcgaaacagttaatgctgtaacaaacgcttatgttgatatgaatgctgataatacaaaacctgtaggatggggatttgatactactattagcacatcaactcttaaagcaggttctattacaaaaattgaactgactaacttagctgagctaggtggtggtttggcagtaaatacggaaatcagagagacagatggaacagtagttggtaaagttaaatctatcgattataaaacaactacaggaaacaacaataacaaatctacaccatattggggacaacgtactcaacgtggaatgacttatgatcagcgtgttgctgagcaaccagcggtagcgaatgaaactggtacatatacttacaacatcgagtggaacgataaagtaaaagactatcctaatgtgtcgtttggagcgagtaatttatcggggagtggatactatgcaccagaaatttcaaaagatactccgtatacagcaactatcaaaattgatgggcgtacagttcttgaacatacttatacaagaaaaggtcaacaacctaactatcaaaaacaaggtactagtgcatcactaagtgaaaacaatggattgacataccttaacaatgagcaaacaggtagaagtgattcaatcgtattaaaaactgattcagatgttcgttatggggtaggatctaaattcactattaaacttccaaatgcagattttactgagtttaaagaacttgaaggaagttctaactttgtaaatggattaaatacagcgtccactattaaccctaataaaggagatagtattacatatcgtccagctagtcgatgggctaatgttaaagctaacgaaaacaacgtttggattctaaacgatggtcgtgatagtgggttcacactaacacctagattaatctcaccaactgagttagaacttacagttacagaaggtgctattcaagaaggttctgtagtttctatgcctcttcaatctttaggtattgaaaaagtaataaaagacaaaaccttaacaagtgaatattctaaaattacttatgaaaatggattaattaaagaaggttatgtaggaaacgataaaactgcagcaactcttactgtatcaggtggagaatctgttaacggtgaaaaagaagacgttgcaactacagtgccaaatggttggagtgttaaaggtgacggtaaagttcaaggtgagccaccaacaggtgctgttgttagaacatttaaagatttagtgacaggtgaagttataggttttgaaccaacaagatatacggggaatattcctttaagtgaagatggttcaaaagattatactaatgtacttggaaacaaatatgatgtaagtaatgatcccgtagacttagttaaagaagttaatggagaagaatacattcttgcagatatccctgctgaaaatacaaaaggaacactaagtgttacgaagacaagagcaagagatttatattctgaagaagaattaaaagctaaaggtataaatggatctgcatttgttaccccagcagagtatgattatgttaagaaaacaaaagtagaagaagtaaaccgtacaattaaatttgtatatgcggataatgttgcaggcttagcgggtacagaagtattcccatcacaaaaacaaactgtaagctacacaggttcaatcaagttaactgcagaaggtaaagcggtaattaactctaatgacagaccagtttatattaactggaaaggaactgatggacaaagcactgatcttccagaacttgcagtacctcaaaaagaaggttacatcgcaagtgtagaaaaagttccagtacaagcaacaacagctacagatgaagattacgaatatgttgttaaatatacagcaatccaaaaagcgaaaacaatatttgtagacgaaaaaggaaatgcaattccaggagtagctgaaattacagaacaaggtggatcagaaactccattaacaaaagaagctgatgttaaagctaagatcaaagaacttgaaaacaaaggatatgaattagtatctaatacatacccagaaggtggtaagttcgatacggataaagatacagatcaagagttcaaagtaatacttaaacaaaaagaagttacagtaacaccagatcaaccaaaaacaccaggaactccagtagatctaaacaacccagacggacctaaatacccagctggcttggaagaaaaagatctaaacaaaactgttacacgtacaatcacttatgtgtacgaagatggaactccagtattaaatgaagatggaacaccaaaaacagtaacacaagaagctaaattcacacgtgaagcaaaagtaaacttagttacaggagaagttacatacggagattggtcagaagctaaagatttagctgaagttaaatcaccagtagtaacaggtttcttagctgataaagcaagtgttccagtagtaaatgtaactggagattcaaaagatattacggaagtagtaacctacaaaccaatcggatcatggattccaaacatcccaggacaaccaacaaacccaatcaaatatccaaataatccagatgatccaacacaaccaggtaaaccaacagaagtgttaccatatgtaccaggattcacaccgaaggataaagatggaaatccacttaaaccagtagatccagcagatccaacaaaaggatatatcgtaccagatcttccaacagatccaagtcaagacacaccaatcaactacgtaaaagacacgcaaaaagcgaaaacaacattcgtagatgaaaaagggaatccaatcccaggtgttgacgctattactgaagaaggtgactcagatacaccacttacaaaagaagctgacgtaaaagctaaaatcaaagaacttgaaaacaaaggatatgaattagtatctaatacataccctgaaggtggtaagttcgataaagataaagacactgatcaagagttcaaagtaacacttaaagctaaagaagttacagtaacaccagatcaaccaaaaacaccaggaactccagtagatccaaataacccagacggtcctaaatatccagctggacttgaagaaaaagatctaaacaaaacagtaacacgtacaatcacatacgtatacgcagatggaactccagtgttaaatgaagacggaacaccaaaaacagtaactcaagaagctaaattcacacgtgaagctaaagtcaacttggttacaggtgaggttacatacggagactggtcagaagctaaagacttacctgaagtgaaatcaccagtagttaaaggatacttagctgataaagcaacagtaccagctacaaaagtaactgcagattcagaaaatactaaagaagtagtaacctacaaaccaatcggttcatggattccaaacatcccaggtcaaccaacaaacccaatcaagtatccaaatgatccaacagatccaacaaaaccgggtcaaccaacagaaacattaccatacgttccaggattcacaccagaagataaagatggtaatccgttgaaaccagtagatccaaacgatccaactaaaggatatgaagttccaagtatcccaacaaatccaggtgaggatacactaattaactatgtagctaacaaagctaacttggtagttaaatatgtagatgaaaatgggaaagaacttctaccaacagaaactaaagaaggtaaagttggtgatgactactctacaagtggaaaagttattactggctatgtattggaccgtgtagaaggtgaagctaaaggtaagattggaacagatggaacaacagtaacatatgtttacaaaccacttggttcttggattccaaacattccaggtcaaccaacaaacccaatcaagtatccaaatgatccaacagatccaacaaaaccgggtcaaccaacagaaacattaccatacgttccaggattcacaccagaagataaagatggtaatccgttgaaaccagtagatccaaacgatccaactaaaggatatgaagttccaagtatcccaacaaatccaggtgaggatacaccaattaactatgtagccaacaaagctaacttggtagttaaatatgtagatgaaaatgggaaagaacttctaccaacagaaactaaagaaggtaaagttggtgatgactactctacaagtggaaaagttattactggctatgtattggaccgtgtagaaggtgaagctaaaggtaagattggaacagatggaacaacagtaacatatgtttacaaaccacttggttcttggattccaaacattccaggtcaaccaactaccccaatcaagtatccaaatgacccacaagatccaacaaaaccaggacaaccaacagaagtgttaccatacgttccaggattcacaccagaagataaagatggcaacccacttaaaccagttgatccgaaagatccatcaaaaggatatgtagtaccaaacatcccaacaaatccaggtgaggatacaccaattaattacattccaaatgtaactccaaatggtgatcaggacggttatactccacaaccaaaaccgcaacctgaacaagttgtgacttactatgtagacgaaaatggtaaagatatcgcaccaagtgaaaaaggagcacaagctccaaaaggaatttcaggttacgaatacgtaacaactacgaaagaccctaatggaaatcttgtacatcattacaagaaagtggcaacaccacaacctgttccaacaacaccagagactcctgaacaaccagtagctccagtgcaaccggaacaaccaacaactccaacccaacctgctgttccaacaccagctgaaacatcagtaccaactgattcagctactaaaccagcaacacctaaatatgttgatggtcaaaaagaattgcctaacacaggtacagaagctaatgctagcctcgcagcgtttggacttcttggagccctaggtggatttggacttcttgctcgcaagaaaaaagaagactaaaaactcatagtttttgagaagatgattcgtcatcttctttttttactctttgtccactgtagtaggtttaagaaaagcggctccataatatctatagaggatgtacccgcgacaaatagtacatctcagaaatagtatatattcatttttgagatgatagtttgttgtcttctatgttgtattttttatgaaatatatatccaagtatgtttaggaagagtttgataatattatttttttgtacctagggcacaaaaataatataaataaatcgagcataaataagatgtatttattgacgagttaattttatttatgataaactggtatggttgtttttggaaccaaaaatttaatatataaatatatatgtgtttctaagaactgtaaaaatttaagttgagagaaaaaggagaaaacatgtattcgagaatggaaaaatatcatggtagaagagcccagcgtttctctatccgtaaatatagttttggggcagcgagtgtccttttgggaacggcacttgttttaggtgctaatggagtacaagctgatgagactctaccagtaaatccgactacttctgattttgcagctacaaataagaaggatgcagactctgctctaacaacacctgtagttgaagaacttccagaattaaagattgatgctgtaaaagcagatgaaaaacctgaagtaaaagaagaggctaaaactgaagcaacacctgtagcagaaaaagaaattactgataaagctgaaaaagaaaaatctgataaagagcaagctgacaaaaaagaagtagataaagaaaaggctgaaacagtaaaacctaaagatgaagttaaatcagttcttactcaattgacttcagaagcagaagtaatggcaacagttgcttcaaacttctcagataaggaagctaaagatgttgaagctaaacaaaaattatcagctgcaattgctgcagtcaagcttgaagcggtagcggcaaaaggtttgctctattctaacgattctacggaagaacaactaacagcccaagtaaatcgcatctcatctgctattgaagcagtctacgctgaaatgaaacgtgcaggtcatgcaggtaaagtagaagctgtgcttggagctacagctgctaaagatcaaaccattacaggtaaaggtgttattagaaatggtaatgcaattgtaacagttaataatgcctatgtgactatgaacgcagataatactgcacctaaagcatggggaattgatgtagtatttgatacatctcaagcgcaaaatggtgatactactacgattgaaatgaaaaacctaacagggtttggagatagctttaaacctggtacaaaaattactgcagcagatggaactgtaattggtgaagtttcatctaaagaaactactaactctgtaggaagtagaggaggagaaagtccattctggtctcaacgtaagaaagatggtaagacttatgaagagcgtcttaccgaacaaccagctattccgaatgaagtagggactactacttacacgattagatggaatgacaaggcgaaaaactatgctgtaacaactttctatgcagaaaacttaacagccattgattactatgcacctaatatttctaaagatacagaatacacagctgcgattagtgtaaatggtcaacaaattttagaacataagtatactcataaagcatctaagtcagcggcacaaaaacaagatacttctgctactattatgggagataacattttaggatataaaggaagtgaacgcgttagaaagagtgatgcagtagttattaatactgatagtgatgtacgttacggaaaaggttctaaatttacgattacattaccaaatgatgattttacgtattttaaagcaattgatggttcaaaaaacactgtcacaaatactaataaggctgatagtataagttaccgtcctgcaggtcgttggaataatgttcaagctaatgcaaacaacgtttggattcttaatgacggtcgtgatacaaactttacattaaaagctactgtaaaatcaccgacagaattagaaatagaagtaatcgatggagcaatccaagaagattcaacagtttcaataggtttagataaacttggagttgagaaagttataacaaaccgtacattctcagacgagtattctaaattcatttacgatgaagctggtcgtttgaaagatggaagtgttgttggagatactgataaaactgcagctactcttacagtttcaggcgggacaccgcttaatggaggagaggaaaatgtaactaccaaagttgcaaacggttggaaagttgaagttggagctggaggtaatagccagtttgaaacaggtgctgttactattactttagtaaatattgaaacaggtgaagagtttgcatatgaacctacaaattatgatggttatgctaagcctaatgaagatggtagctatgaaactaagaacattttaggtaaaaaatatgatgtttcaaaccaagttcctgatttaactaaaactatcaaaggtgttgagtatattcgtgttgatgttccgtcaaaaggaacaacaggaactgttaatattggtccaaaacgtgctagcgctatctatagttcagaggaacttcaagcgaatggagtaaaccctaatgcttttgtaaataatgttgtttactactatgttaagaaaacaaaagtagaagaagtaaaccgtacgattaagtatgtttacgcagacgatgttaaggatcttgcaggacaagaagtatttgaaccaacaaaacaaactgtaagctatacaggtactatccaagtaaatgataaaaatgaagcgcaggtagatgccaatagaaaacctatctatattaattgggttggaaacggtgatacaaaccttccagaagtaacagtacctcaaaaagaaggttacattgcaagtgtagaaaaagttccggtacagccaacaactgcaacagatgaagattacgaatatgtagtaacttactcaccaatccaaaaagctaaaacaacatttgtctaccaagacaaagatggtaatgttaagcaagtggaaggtaacacgccaatctctgaaacaggtaaaggtggagacaaacttacaaaagcagatgaaatcgctgcgagaatcaaagaagctcaaaacaaaggatatgaagtagtttctaatacatatccaacagatggcgtctttgataaagatgtcgacactgaccaagagttcacagtaacacttaaagaacgtgttgtaccagttacaccagatcaaccaaaaacaccagggacacctgttgatccaaacaatccagacggacctaaatacccagctggcttggaagaaaaagatctaaacaaaacagtaacacgtacaatcacatacgtatacgaagatggcactccagtattaagcgaagatggcactccaaaaacagtagcacaagaagcaaaattcacacgtgaagcaaaagtaaacttagtttcaggtgaagtgacttacggagattggtcagaagcaaaagacttatctgaagttaaatcaccagtagttaagggatttgtagctgacaaagcaagtgttgcagtggtaaatgtaacaggtgattccgaagatattaaggaagtagtaacctacaaaccacttggttcatgggtaccaaacattccaggtcaaccaacagacccaatcaagtatccaaacgatccaacagatccaacaacaccaggaactgataaaccaaaagtaccatacgttgaaggattcacacctaaggataaagatggaaatccacttaaaccagtaaatccaaacgatccaaaagaaggatatgaagtaccaaatcttccaacagatccaagtcaagatacaccaatcaactacgtaaaagatacgcaaaaagcaaaaacaactttcgtagatgaaaaaggaaatccaattccaggtgttgacgctattactgaagaaggtgattcagacacaccacttacaaaagaggctgaagtaaaagctaaaatcaaagaacttgaaaacaaaggatatgaattagtttctaatacatacccagaaggcggtaagttcgataaagataaagacactgatcaagagtttaaagtaacgcttaaagaacgtgttgtaccagttacaccagatcaaccaaaaacaccagggacacctgttgatccaaacaacccagacggacctaaatacccagctggcttggaagaaaaagatctaaataaaactgttacacgtacaatcacatacttatacgaagatggaactccagtattaaatgaagacggcactccaaaagttgttacccaagaggctaaattcactcgtgaagctaaggtcaacttggtaacaggtgaagtgacttatggagattggacaccagctcaagacttggctgaagtgaaatcgccagtagtaccaggatacttagctgataaagcaagtgtaccagttgtaaatgtaactgcggattcaaaagatactacagaggtagtaacctacaaaccacttggttcatgggtaccaaatatcccaggtcaaccaacaaacccaatcaagtatccaaatgatccaacagatccaacaacaccaggcaacgacaaaccagttcttccatacgtaccaggtatgactcctaaggacaaagatggtaatccgttgaaaccagtagatccaaacgatccaactaaaggttatgaagtaccaaatgttccaactaacccaggtgaggatacaccaatcaactacgtgaaggatacgcaaaaagcgaaaacaactttcgtagatgagaaaggaaatccaattccaggtgttgatgctattactgaagaaggtgactcagatacaccacttacaaaagaagctgacgtaaaagcgaaaatcaaagaacttgaaaacaaaggatatgaattagtatctaatacatacccagaaggtggtaagttcgataaagataaagatactgatcaagagttcaaagtaacacttaaagaacgtgttgtaccagttaccccagatcaaccaaaaacaccaggagcacctgttgatccaaacaacccagacggacctaaatacccagctggcttggaagaaaaagatctaaacaaaacagtcatacgtacaatcacatatgtgtacgaggatggaactccagtgttaaatgaagacggaactccaaaagttgttactcaagaggctaagttcactcgtgaagctaaggttaatttggtaacaggtgaagtgacttatggagattggacaccagctcaagacttggctgaagtgaaatcaccagtagttaaaggatacttagctgataaagtaacagtaccaactacaaaagtaactgcggattcaaaagatactaaagaagtagtaacctacaaaccacttggttcatggattccaaacattccaggacaaccaactaacccaatcaagtatccaaatgatccagcagatccaacaaaaccaggaagtgataaaccagttcttccatacgtaccaggtcacacacctgttgatggaaacggacaaccacttaaaccagtagatccaaaagatccatcaaaaggatacgaagtaccaaatgttccaactaatccaggtgaagatacaccaatcaactacgtagcgaacaaagcgaacctagtagttaaatatgtagatgaaaaaggcaaagaccttctaccttcagaaactacagaaggtaaagtaggtgatgagtacgctacaagtggaaaagttattactggatacgtattggaacgtgtagatggagaagcgaaaggtaagattggagaaaacggtacaacagtaacttatgtttacaaaccacttggttcatggattccaaacatcccaggacaaccaacaaatccaatcaagtatccaaatgatccaacggatccaacaaaaccaggccaaccaacagaagtagtaccatacgtcccaggctacacacctaaggataaagatggtaatccgttgaaaccagtggatccaaacgatccaactaaaggatatgaagtaccaagtgtcccaactaacccaggtgaggatacaccaattaactacgtagcgaacaaagctaacctagtagttaaatatgtagatgaaaacggtaaagagcttctaccttcagaaactacagaaggtaaagtaggtgatgagtacgctacaagtggaaaagttattactggatacgtattggaacgtgtagaaggtgaagctaaaggtaagattggagaaaacggtacaacagtaacttatgtttacaaaccacttggttcatggattccaaacattccaggtcaaccaactaacccaatcaagtatccaaatgatccaacggatccaacaaaaccaggaagtgataaaccagttcttccatacgtaccaggtcacacacctgttgatggaaacggacaaccacttaaaccagtagatccaaacgatccaacaaaaggatacgaagtaccaaatgttccaactaacccaagtgaggatacaccaattaattatattccaaacagtcctaagccaaacccaactccttacccaggaccaactccagctccaactcctaaaccagagcctaagccggaaccagcaccagttccaacaacaccagagactcctgaacgaccagtagctccagtgcaaccggaacaaccaacaactccaacccaacctgctgttccaacaccagctgaaacatcagtaccaactgattcagctactcaaccagcaacacctaaatatgttgaaggtcaaaaagaattgcctaacacaggtacagaagctaacgctagtcttgcagcgcttggacttcttggagccctaggtggatttggacttcttgctcgcaagaaaaaagaagactaaaaactcatagtttttgagaagatgattcgtcatcttctttttttatttcggtgtttttacttgcgtaaaaaatttttttctagtataatagtttattgtgagcgaacctcacttaccccttgcaaagtcttggggtcattagaccaaaaggaggaacatatcaatggctaaatacgaaattctttatattattcgtccaaacattgaagaagaagctaaaaacgctttggtagcacgttttgactctattttgactgacaacggtgcaactgttgttgaatcaaaatcttgggaaaaacgtcgtcttgcatacgaaatcaaagatttccgtgaaggactttaccacatcgttaacgttgaagcaaacgacgatgcagctcttaaagagtttgaccgtctttcaaaaatcaacgctgacattcttcgtcacatgatcgtcaaaactgacgcttaagaaggtaaactatgattaacaatgttgtacttgtagggcgtatgacacgtgacgctgagttgcgttataccccatcaaatgtagcagttgcgacttttactcttgcagtaaaccgtacatttaagagtcaaaatggcgaacgtgaggctgattttatcaatgtcgttatgtggcgccaacaggctgaaaaccttgctaattgggctaaaaaaggctcacttatcggggtgacaggtcgtatccagactcgtagttacgataaccagcaaggacaacgtgtctacgtgacagaggtcgtggctgagaatttccaaatgttggaaagccgtagtgtgcgtgaaggtcacacaggtggagcttattctgcaccaagttcaaactattcagcgcctacaaattcagtaccagacttttcacgtgatgaaaatccatttggagcaacaaatccattggatatttcagatgatgatttaccattctaatggacaactaaaattataaaggagaaaaaacatggctcaacaacgtcgtggcggattcaaacgccgtaaaaaagttgattacatcgcagcaaacaaaattgaatatgttgattacaaagatactgagcttcttagccgtttcgtttcagaacgtgggaaaatccttcctcgtcgtgtaacaggaacttcagctaaaaaccaacgtaaagtaacaacagctatcaaacgcgctcgcgtaatggctttgatgcctttcgtaaacgaagattaaagaaaagacccggttgggtctttttttcacgagccttgaaatgagagagcgagtttgggttcgggtggacctctttttcagacccggttgagtctttttttcacgagatagtttttttctgactttggcgtgctataatggtaatagaaagagtaaaggtgggtaagtcaaagatgaattgtacgattagaaatatgattaagtctgatattgaatccttatctcatggatttatgaatcaaggttggcctggtagagaggaaattttggctagatattttctggaacaggaaagtggggagagagaagttttagttgcagagattgatggtgctgtagcgggctacattaccattttgccctctgctaaacacgggccttttgcgtcaatctatccagagctttcagatttcaatgtgtttgaaccatttagaaataaaggcataggcaataggctcttagaaaaagcggaacaaggagttaagcgtttttctggtaaagtatgtctaggtgtaggtttgcacttggggtatggtcctgcccagagattgtatatcaaacgaggctatattccagatgggacaggtgtctggtatagaaataaaccgctagaaatgggtgcaagttgtcaaaacgatgatgatttagttttatacttatccaaggacttacaataaaacgggaaactttttgaaaataggggatttagctactttatggtataatggaaagagttagattgaaagaggtagtgagatggatgccaaattaagatacaaggcaaagaaaatcaagattgtcttttttgatattgatgatacattgcggaattcaaagacaggttttattccagcttcaatcccaactgtttttaagcaattacgtgagaaaggaattttgacaggtattgcttctggacgagggatttttggtgtcgtaccagagattcgtgagctaaagcctgacttttttgtaaccttaaatggtgcctatattgaagataaaaaaggtcaggtcatttaccagcatcagatcgagaagtcagatgttgaggagtatatctcttgggctaaggaagaaggaattgagtatggcttggttgggagtcatgacgccaaattatcgactcgcaccgatatgattagtgaggctatcaatccaatttaccccgatttggatgtggatcctgatttccatgagaaagaagacatctatcagatgtggacttttgaagacaaaggagatgacttacacttacctgacagtctctctgacaaacttcgcatggttcgttggcatgagcattcgtctgatattgtgccgatttcaggctccaaagcgacgggtgtggaaaaggttgtggaacaccttggcttgaaaccagagaacgtcatggtttttggagatggcctgaatgacttggaactctttgattatgctggaatcagcgttgcaatgggaatttctcatgataacatcaaagaaaaagcagattatattacaaaaacattagaagaagatggcatttttgatgccttagaaggatttggtatggtagaaaaagaattgcatttcccacaagtagatattgaaacagtagaaggtcctatcgcgactattaagactaatcacggagacttgcgtattaagctcttccctgaacatgctcctaaaacagtagctaactttgttgcactttcaaaagatggctactatgatggtgtcattttccaccgtattatcwaggactttatgattcaaggtggagatccaactggaactggtatgggtggcgagtcaatctacggcgaatcatttgaggatgaattctcagaagaactttacaatatccgtggtgctctttccatggccaatgctggtccaaataccaacggcagccagttctttatcgtgcaaaatcaacacctgccttattctaaaaaagaaattgctcgtggtggttggccagaaccgattgcggaaatctatgccaaccaaggtggawyccctcacctagaccgccgtcacactgtatttggtcagctagctgatgaagcttcttacgctgtcttggatgccattgctgctgttgagacaggagctatggataagccagttgaagatgttgtgattgaaacaattgaaatcgaggactaagatgaaaatcggtgataagctaaagggccgtattacagggattcagccctacggagcctttgttgagctagagacgggtgatacggggctgattcacatttcagagattaggacaggctttattgaaaatatccaagaagccttgaaagtcgatgaagaggttcaagttcaagtagtggatttagatgaatttacagggaaagctagtctttctatccgcactttggaggaagaaaagcaccagtttccgagacggcgacgcttttcaagcgaccgttttaac

SEQ ID NO: 59 - DNA, 100480 bp, Streptococcus mitis NCTC 12261 contig5
tattaaaatcatgtagagcgcattaaccagctcttttcgacagatattaaaatcattcaaaatagagaggtttttagctattcggtggatagtgttctcttgtcacgttttccacgttttcctaaaaagggcttgatagtggatttctgtgctgggaatggagcagtggggctttttgctagcactcggactcaggcacagattttggctgttgagattcaggagcgtttggcggatatggctgaacgctctgtccgtttgaatggtttggaagagcagatggaggtcatctgtgatgatttgaaaaatatgcctgcttacatccagggaagtaaggtggatatgattttgtgtaatccgccctatttcaaggtggatcctcattctaatctgaacgagagtgaacattatctcttggcgcgccatgaaattacgactaatttgcaggaaatctgtcgtagtgcccagagtattctcaagtctaatgggcgtttggccatggttcatcgtcctgatcgacttctggatattttggatacattacaacggcataatctagctcctaagcgcctgcagtttgtttatccaaaaagagaaaaggaagccaatatgcttttgattgaggcaatcaaggatggttcaacaagcggctttaaggtcttaccacctctcattgttcacaatgatgatggctcttatacgcctgaacttgaagagatttattatggatcataaggcttatatgtacgtgctggagtgccgtgatggatcttactatacaggctatacgactgatgtgagaagacgccttgctgtccacaatagtgggaagggagccaaatacacacgagcacgcttgccagtcaaacttatctatgttcaaggttttgccagtaaggaagaagccatgtcagcagaagcccttctcaagcgtaagaagaggccacagaaggaaagatttttatctgaaaatcaagatagaaatttactcatactcaatgaaaatcaaagatcaaactaggaagctagccgtagtcagtacttgagtacggcaaggcgaagctgacgtggtttgaagagattttcgaagagtatcagttattttgaagaattgtgaggagccctttgactcctcttacttttgtcaaaaagcgaaaaaaatgctacaataaagagaataaataaaatgaggtattatcatgtctaagattctagtatttggtcaccaaaatccagactcagatgccatcgggtcatctgtagcctttgcctaccttgcaaaagaagcatacggtttggatacggaagctgttgctcttggaactccaaatgaagaaacagcctttgtcttgaactattttggtgtagaagcaccgcgtgttatcacttctgccaaagcagaaggagcagagcaagttatcctgactgaccacaatgaattccaacaatctgtatcagatatcgctgaagtagaagtttacggtgttgtagaccaccaccgtgtggctaactttgaaactgcaagcccactttacatgcgtttggagccagttggttcagcgtcttcaatcgtttaccgtatgttcaaagaacatggtgtagccgtgcctaaagagattgctggtttgatgctttcaggtttgatttcagatactcttcttttgaaatcaccaacaacacacccaacagataaggttattgctcctgaattggctgaattggctggtgtcaacttggaagagtatggtttggctatgttgaaagctggtacaaacttggctagcaaatctgctgacgaattgattgacatcgatgctaaaacttttgaattgaacggaaataatgtccgtgttgctcaagtaaacacagttgacatcgctgaagtattggaacgccaagcagaaattgaagctgcaatgcaagccgctaacgcagcaaatggttattctgactttgtcttgatgattacagatatcgtcaactcaaactcagaaatcctagcacttggtgctaacatggacaaggttgaagcagccttcaacttcaaacttgaaaacaatcatgccttccttgctggtgctgtttcacgtaagaaacaagtggtacctcaattgactgaaagctttaatgcttaagattttgagtgttaattcaaattaggaaaggctagtttgacttatatcgaaaggagtttcggctcctttttttctaggagtgaagcatgttagaaaatggcgatttgatttttgtgagagatgagtcagatatgggacaggccattcagacttccacaggcaactataaccatgttgcgatttgtttggatgggatgatttaccacgctagtggacaggatggtgttgtctgtcaggaaccagtagacttctttgagtccaatcacttgtacgacctctatttctacccagaaatggatatccagtctgtgaaggaaaaagcttgcaaacatctaggaacaccctacaatgcttctttctatccagctggacctggtttctactgttcccagtacatggcagaaatcctaccgatttttgaaacgattcccatgaaatttggagatggggagcaggagattagtgatttttggagagagtattacagagaactaggtctgcctgttcctttgaaccaagctgggaccaatcctagtcagttggcagcatcgcctctgttagaatgtaaagaaaggaatcttcatgattcagatttttaatccatctcgtttgacgagacagccattttttagagaattgatccgctatctggaccagcatgaggatgtgattttgcgagaaattaaggctcaatttccagatgttgcagttgataaactcatggaagagtatataaaggcaggtttgattctacgagaaaataagcgttattaccttaatcttcctatgcttgaatcactcgatagtctcgaactggatcaagagatttttgtcagcgaagatagtccagtctatcaagccttgttagagcagagttttgagacagaattacgaaatcaaaccaatgcagctattttagttgaaaagacggactttgcgagaacagaaatgaccttgtccaattatttctacaaggtcaaacatcagtatcctttgacagaaaaacagcaggagctttacgacattttgggagatgttaatcctgagtatgctctcaaatatatgacgacttttttgttgaaatttctcaaaaaagaccagcttatacagaaacgccgtgatatctttgtggatagtttggtcgtcctagactatattgtccaaaatgaagaggggaagtatgagttgaccgtcgattttgacaaggagagattaactttctacttagcgtgaaattttgtttctgagcacattgtttgactttccttaggattaagtataaactatatgtaaccggtaacacatatcggaataaactaaaggagacaatcatatgtcacttgaaaacaaattggaacaagcaacaggcgctatcaaagaaggatttggtaaagttactggggatagcaagactgaagcagaaggcgctgtagaaaagacagttgctaaggcaaaagaggtagttgaagatgctaaaggtgctgtagaaggtgccgttgaaggtttgaaaaacgcttttaaataaaaatagaaaaaatcaagggtttcatttcccttgattttttactatcttataaataattttctgcgacggctgcatctcctggataggcttctttcttgccttgaacgatttggtagcaatcggctcccttaccggcgataataactgcatctaattcgtgatttgtgatagccatagctgccttgatggcttcttggcgatccgcaattttttcaacaggatgattgatgtaactcctaatttcatctgcaatggccattgggtcttcatagttagggtcatcagcagtcaaaaagacttgaatctcagggtgttgattgaggagaagtccaaagtccttacgacgactttctcccttatttcctgtcgaacctaacaccagagcaatctttcctgtttgatgagtctctacaacattgatgagttttttgagactgtcaccattgtgggcgtagtcgatgaaaaccttggctccgtttttctgagtgaggacttccatacgaccaggaacacgggttgcagcgattccttttttgatgtcctcaagactagctccgagacggaggcaagcaagtccagcagcaacggcattttcttggttaaagtggccaatgagttgaatatcataatctccagcgagtttacccgtagctgaaaagctaaaggctttggaattctcgatttggttatcagactggctgccgtagaaatcatggtcttgatcttctacttgttctttcaagacagaaaagtgatccatgtcactattaatgatgactgctcggctattttccatcaagagacgtttgtggtagaagtagtcttcaaagctagggtgttcaatcgggccgatatggtcggggctgatattgaggaaaactcccacatcaaaggttagaccatagacacgtttgaccagataggcctgactggagacctccatgatgaggtgagtacggtcattttgcacagcttgattcatcatgtcaaagaggtcaatactctcaggggttgtcaatgcagacttaaagaaagtcttgccatctagagttgtattcatggtcgagagcatagcaggtcgatgcccttgagataaaatgttataggcgaagtaggctgctgttgttttacccttagtaccagtaaaggcaaggagtttgagttttttctgtggattgccataaaattccatagctaccaaactcatggctttcttgatatcactgacgataatagcaggaataccaacctcataatctttttcagccacataccaaccgaggccttgagagatggcagaaatcaggaattccttcttaaaggcagcacccttgacgaaaaagaggctcttctctttggccttgcggctatcatagcagatggtgtcaaatatgacatggctgtagttgtagtgataatgtccttggtcgataatctcacggaagagatcatctttctttaaaatatctaatacggtttcaatcttaatcatactttctattgtaaaccgaaagtcgtaaatttacaagtaacaaggaaaagtttataatggaagatgaggaatttttcctagttattaaaattaaatgaggaatctatgtctaacgaaaacaatcaccagcaggcccagatgttacgagggactgcttggctaacggctagtaactttatcagtcgtctactcggggctatttatattatcccttggtatatctggatggggtcttatgcggctacagcaaatggtctcttcaccatgggctataatatctatgcctggttcttgctggtttcaacagcgggtatcccagttgcagtggctaagcaagtggccaagtataataccatgcgagaagaagagcatagctttgccctgattcggagctttttaggctttatgacaggattaggtctggtttttgctttagtcttgtatgtctttgctccttggctagcagatttgtcaggtgtagggaaagacctgatcccaatcatgcagagcttggcttgggcggtcttgattttcccatctatgagtgtgattcgaggcttcttccaagggatgaataacctgaaaccttatgccatgagccaaatcgctgagcaggtcattcgtgttatctggatgctcttagctacctttatgattatgaaaatgggttcaggggattatctagcagcggttacccaatccacctttgctgcttttgtcggcatggtagctagttttgcagttttgatctatttccttgccaaagaaggattacttaaaagagtccttgaaacaggagataagataaacagcaagcgtcttttggtcgacaccattaaggaagccattccttttatcctgacagggtctgctatccagcttttccagattttggaccagatgacctttatcaatagtatgagttggtttaccaactatagtaatgaagacttggttgtcatgttttcttatttctctgccaatcctaataaaatcactatgattttgatttctgttggggtttcgattgggagtgtaggtttgccacttttgactgaaaactatgttaagggggacttgaaggcggcttctcgtctagttcaggacagcatcaccatgcttttcttattcctactgccagcaactgttggagtggtcatggtaagagaatctctttatacagtcttctatggtaagccagatagtttagctatgggcttgtttgtctttgccgttttgcagtctaccattttaggtttgtacatggtcttgtctccaatgcttcaggccatgttccgcaaccgtaaggccgttctctactttatctatggttcgattgtcaagctagtcttgcaaatacctaccattgctctctttcacagttatggtcctttgatttccacaactatcggtcttatcattcctaacgtcttgatgtatcgggatatttgtaaggtaacgggtgtcaagcgcaagattattgtgaagcgaactattttaatcagtttgttgacttttgttatgttcatcagtgtaggcgctatccagtgggtactgggatttgtcttccaaccaagtggacgtttgtggagttttctatatgtagcccttgttgggtgccatgggtgggggtgtttatggagttatgagtctccgtacccgtctattggacaaggtgattggaaaagctcaagcagatcgcttacgaatcaaattaaagttaacttaaaaaaacatttataaataaaagggataatttgaacatttctatcatgaaatgcttgaattattctctttttattattttgtagaataatttctatagtttgtggatagtaatttaatttttcttaaattttacttaaaaagctattgactaaataaaactcaagttgtataataagacaaatatttaaatcaggaggttctggagatgaaaaagtctaaagccaagtatgcagcacttgcaggtgtcgtgttaagtgcaggtattttattaagcgcgtgtggaagttctagcacagggtcaaaaacatataactatgtttataccagtgatccgtctagtttgaattatctagcagaaaaccgtgcaacaaccaatgatattgtgactaatctagtagatggtctcatggaaaatgaccagtatggaaactatattccatctttggcagaggattggagtgtttctaaggacggtttgacctatacctacaaactgcgtaaagatgctaaatggtatactgcagatggagaagaatatgctcctgtaactgcccaagattttgtaactggtttgaaatatgcagcagataaaaaatcagaagccttgtacttagttcaagaatccgttgcaggtttggatgattacattaacggtaaaacaagcgacttttcaactgtcggagtcaaggcacttgatgaccaaactgttcaatataccttgacacgaccagaatcttactggaactcaaaaacaacttcaaccattctcttcccagtcaatgcggatttcttgaaatcaaaaggggatgattttgggaaggtagacccatctagtattttgtacaatggacctttcttgatgaaatcctttgtttcaaaatctgttattgaatttaagaaaaatccgaactactgggatgctaaaaatgtctttgtagatgatgtgaaattggcttattatgatggtagtgaccaagatgcactagctcgtaactttgttgagggagcttatagttatgctcgcctttatccaaatagtgcaagctttgaaggtattaaagaaaagaataaggacaatatcatctatagcttgcaagatgccacttcttatttcttaaactttaatctagatagaaaatcttataagttcacttccaagacaagtgatgctgaaaagaaatcgactcaggaagcggttctcaataaaaacttccgtcaagccattaactttgcctatgatcgtacagcttacggggctcaatctcagggagaagatggtgcaactaagattttgcgtaacttggttgttcctccaaacttcgtaagtatcaacgggaaagactttggtgaagtagtagcctctaagatggtgaattatggtaaggaatggcaaggaatcaactttgcggatgcccaagattcatactacaatgctgaaaaagccaaggctaaatttgcagaggctaagaaagaactccaagctaaaggagtccaattccctattcacttggacatgacagttgaccaagctgctaaacagggtgttcaagaggcaaattctatgaagcaatctattgaagcagctttaggtgcagaaaatgttgtaattgatattcaacaacttactactgaagactatgataatacaagctatttggctcagacagcagctcagaaggattatgatctatacaacggtggttggggtcctgattaccaagatccttcaacctatcttgatgtcttcaatcttaattctggtggtttgttgcaaaatctaggtttagagccaggtgaagccaatgacaaagccaaggctgttggattggatgtctacactcaaatgttagaagaagccaataaggaacaagatcttgcaaaacgctatgaaaagtatgctgatatccaagcgtggttagtagatagcgctttagcgattccaaatgtttctaagggtggaacaccaacattgagaaaagttgttcctttctcaacaccatattcattagctggtaataaaggtatcgaatcatataaatatctcaaagtacaagataaaacagtcacaaaagatgaatatgaaaaagccaaagaaaaatggctgaaagaaaaagaagaatccaataaaaaagcccaagaagaattggcaaaacatgtcaaataaggatttttcaagaaaaacgatggtttcaaaagaaactgtcgttttttatagaatgatggcgaagttggaagaaaagtgcttacattttttaaattgtttatcaaatttatgatataatgaatataataaaagttgtgagaagctatttttttaaatcctcttccagtgttaactgaagtatacacatgctaggatgattttataggaggggatgccgtctactgtaaaagtaagataaaactcaataattgataagttcttctttaaatgaagaattcttaactggctatttactaatagggaggtatcatcatgggcgctattatggagtttgcaacagaaaaacagattgcatcatttctctcaacttgtcacattgaaggacaaaagaattttctgatggctttcaagaaaaagacatggttgaaatcctttattgattttttcattataggtggttcctactatgttcagtcgagtgtgaagcctaagattctagcattcacatctaagggaatctacttgatggacatcagtgatgtgactgagaaacgttctaatcacgtcgtagagatgccttggaatcaagttcaagattttacttataagacagccttgaatacagttaggctgaattggaattatcaaaatgaagactatattttttccgtggatgtcggtcagattggtcagcatgtgggccaatatcaatttaataaagaccattatgactatttagcccaacaggatttctttcagtcaaagtaaactctagcaatcattttcacaaaagaatctggaagcttttctggattctttttagctttactcgataagtctatagtttgaaactataactagctcttgaaaagaagaaaatgagttgatgaaaataagtggtacaatagttactatagatttggaggtattgtatgagcaaggaattacacattaacacaattttggcccaggcgggcattaagtcagataaagcgacaggagctttggtgacaccgcttcatttttcaacgacctatcagcatccagagtttggtcaatctactggatttgactatacgcgcaccaaaaacccaactcgcagtaaggctgaagaagtcttggcggctattgagtcagcagactatgccctagcgactagctcagggatgtcagctattgtactggcctttagcgtttttccagtaggaagtaaggtcttggctgtccgtgacctttatggtggttctttccgctggttcaatcaagtggagcaggaaggtcgtttccattttacctatgccaatacagaagaagagttgattgccgagttagaaaaggacgtagatgttctctatatcgaaaccccaaccaatcccttgatgttggagtttgatatcgaaaaactagcaaaattagctcatgctaagggtgccaaagtggtggtggacaatactttctacagccctatctaccaacgtccgattgaagatggagcagatatcgttcttcattcagcaaccaagtatctagcaggccacaatgatgtcttggctggagttgttgtgaccaatagtgtagaattatacgaaaagcttttctacaatctcaatacgacaggggcagtcttgtctccatttgacagttatcaattgattcgtggtctcaagtccttgtctcttcgtatggagcgctcaacagctaacgcccaagaagtggttgcctttttgaaggattctccagcagttaaggaagttctctacactggtcgtgggggtatgatttcctttaaagtagcagatgaaacacgcattcctcacattttgaacagtcttaaggtcttctcttttgcggaaagtttgggtggggtagaaagtctcattacttatccaacgacgcaaactcatgctgatattccagcagaagtgcgccactcttatggtttgacagatgacctcttgcgtttgtcgattgggattgaggatgctagagatttgattgcagatttgcaccaagccttggaaggataagaaaaagatgggaaaatatgattttacaagcctgcccaatcgtttagggcaccatacctataaatggaaagaagcagaaacggatagtgaagtcctaccagcttggatagcggatatggactttgtagtcttgcctgaaatccgccaagccgtgcagacttacgctgatcaactggtttatggctatacctatgccagtgaagagttaattaaggaagttcaaaagtgggaagccacacaacacggttaccactttgacaaagaggctcttgtctttatcgagggtgtggtaccagccatctcaacagctattcaagcctttacaaaagaaggcgaggcggttttgattaacacacctgtctatccaccctttgcacgcagtgtcaagttgaacaaccgcagattgattaccaattctttggtggaaaaagatggtctgtttgagattgactttgatcaattggagaaggatttggtggaagaggatgtcaaactctatattctttgcaatcctcacaatcctggtggacgtgtttgggaaaaggaagtgttggaaaagattggccaactctgccaaaaacacggtgttttcttggtttcggatgagattcaccaagatttggccctctttggtcacaagcatcattccttcaataccattaatcctgccttcaaagattttgcgattgtcttgagcagtgccactaaaacctttaacattgctgggacaaaaaattcctatgcagttattgaaaatcctaagttgagactggcttaccagaaacgccagttggctaataatcaacatgaaatttcaggtttgggttatttggcgacagaagctgcctatcgctatggtaaggattggttagaggaactcaagcaagtctttgaagaccacatcaattatgtggtagatctatttggaaaagagactaaaatcaaggttatgaaaccgcaaggaacctacttgatttggcttgatttttcagcctatgacctgactgatgaaacattacaagagcttttgagaaatgaagctaaggttatccttaaccgtggtttggattttggagaggaaggaagtctccatgctcgcctcaatgtagccatgcctaaatctctgttgcaagaagtgtgtcagcgaattgtgacgacttttgctaaactttaaaaatccagccttctaggagaaaagtatccttagaaggctattttcataggggaaaatatggtataataaaaagataaggtaaaggtaaaaatatggctaaattgattccggggaaagtccgtatcgaaggcgttgccctttatgaaactggtaaggttgacattatcaaggaaaagaacaatcggctctacgctcgcattgcagaagaagaactgcgctatagtttagaggacgatttggttttttgtgcctgcgattttttccaaaagaggggctactgtgtgcatttggcagcgttggagcattttctaaaaaatgatgagcgtggtcaggaaatcttgcagagtttggaagaaggccatgaggaaaaagaggccgttgaaaccaaggtgaccttaggtggaaaatttttggaccgaatcttgtctccaaaatcagaccgagcctatgagttgtcggctgtgggtcaggtggaagcaggaagcaatcatatcttgtggacgcttagaatcgggcaaatcaatagccaaaaatactacgttattcgggatattccactctttttaaaagttgtcgagaagagaaagccttatatgattggcaagacctatgaggaatccttgtcttgggaatcctttgatgaggccagccaagaacttttgactttcttgcggggactagtggaggaaggacaggctccagagctctttttccaaaaccaaggtcggcatctctttttccctctgacttttttttgagcagggtgtgaatttactgatggccttgccccattttcaatttgaccatcaagtggatagctaccaaaccctgctttttcaggatttgcatgcggatgccaatctatttacctttacagtaacagaatactcggactattttgaaatggaaatcagtgagagtccgagggtcaatgccttttatcaaggagctgtgcttttccataaaggacaggtttattttctaacagaccagcagatgcgccttctcaaggaaatcaaagcgctgcctttggatcaacaaggaaagaaatatctgcaatttgatagcagtgatcgagataagttggcttcttgtctaacgctctttggtcagatgggcaccgtttcagctccagaacgtctacatatcaaaacttttacaccctctttttactttgacagggaagaagacaatcggattcgtttagaaattcagtttgattatggagacaggaaggtatctagcagacaagagctagaagaattacctttttcgagtgatgctgacttagaagaaagagtttttcaagtctgtttggcagctggatttgaagcggattttcaatcttggcgtcaggctttaaaagcagagtctgtttatcatttcttccatgaaatcattccagtttttgaaaaactcggaaatgttgatctatcagacaagctagaagaaatttatagcctagcaagccctcaagtgcagattgcttccaagggaggtctcttggaaatccagtttgattttcaagatatcgcccaagaggaaattgaccaagccatgaaggccttggttgataatcgagatttttatattgattcgtctaatcaagtctacttttttgatgaagagaccaagaaaattcgccaaaatctacaggaactggggcagtttgaattaaaagatgggaccttgaaggctcgaaaatccttggcttatagtttagctcatctctttgaaggacgtgaccgtgtttctttttcacaagaattccagaatttggcccaggatttgacgcatccagaggacttccctagacaagcaactcaagtcaaggctgccttgcgagattatcaggaaaaggggatcggctggctacaaatgctccatcattatggttttggtgggattttagctgatgatatgggacttggtaaaaccctgcagaccattgcttttttgaccagtcaagtgacaaaagaaagtcgggtcttgattttagctccatcaggtttgatttacaactgggcagatgaatttcagaaatttgctccacagttggatgtggctgttgttcatggtttaaaggctagtcgtgaagagattcttgctgaaagccatcaaatctatgtgactagctatgctaccttccgtcaggacagtgagctttatcaggggatggcctttgacttccttttcttagatgaagctcaggtcatgaaaaacgcccagactaagattgcccagaccttgagacaatttgtggtgccatcagtttttgccttgtcaggaactccgattgaaaaccatctgggtgaactgtggtctattttccaaatcgtcatgccaggacttttgccaagcaagaaagaatttatgaaattgccagctgagcgcgttgctcagtttatcaaacctttcgtgatgcgacgtaagaaagaagaagttctgactgaattaccagacttaatcgaagtggtttataaaaatgaactggaagaccagcaaaaggctatttacctagcccagttgcaacagatgcgagaccgtctggctcaagtgtcagatcaggaatttcagcgaagtcgtgtggaaatcttgtctggtctgatgcgcttgcgtcaaatctgtgacactcctgccctctttatggaagattatcagggagccagtggcaaactggatagtcttcgagacctgctactacaggtggcagacggcggacaccgtgtcttgattttctcgcagttcaagggaatgttggagaaaattgaacaagaattgccagacttgggcttgacttcctttaaaattaccggttcgaccccagccaaggaaagacaagatatgaccaaagcctttaaccaaggggaaagagatgcctttctgatttccctcaaggctggtggtgtcggtctgaatctgacaggtgctgatacggttattttggttgacctttggtggaatcctgcggtggaagcgcaagctattggccgtgcccatcggataggtcaggaagaaacggttgaggtttatcgcttagtgaccaggggaaccattgaagaaaaaattcaggaactccaagaacaaaagaaacatctagtgtcacaagtattggatggaacagagtcacgtggcagtctcagcctagcagaaattagagaaattttgggaatttctgaagccagcacttgaaaaatcaagacaatacgctataatgaagtgttgaaaggaaatagaaaatgagagaagaacgatttccattggtgtcagatgatgagatcatgttgactgagatgccggttatggacctctatgatgaatctgactttatcagtaatatcaagggagaataccgtgataagaattatctggagtgggcccctattactgaagaaaaaccagtaaaacagattgaaaagctagtagagaaacctaagaaggctggtttaggagttaaaaaagaaggaaaaagctatgcggaggtggcgcgtgaagaagcgcgtgcggacttgaaaaagaaacgctcagcaagttatctgactaaggatattactcctacaaggcgcccttctcagcaacgtttggatagacagggcaatcaacctaccgcgcctttccaaaaggaaaatcctggcgaatttgtcaaatacagtcaaaaattgactcagtctcattacatcttggcggaagaagtgaacaatatgtcgactcaagctgagccaaaagaaacttcaggcccaaagaaaaacaattatgattttctgaagaagagccaaatctacaataaaaagaatcaacaaaaagaacaagaacgtcaggttgcccaagagttgaatctgacaagaattacggaataggggagaaaacatgtcaaagacatatcattttatcggaattaagggatcaggtatgagtgccttggccttgatgttgcaccaaatggggcataaggtacagggttcagatgttgaaaagtactactttactcaacgtggtcttgagcaggcaggaattaccattcttccttttgatgaaaagaatctagacggtgatatggaaattatcgctggaaatgcctttcgtccagataacaacgtcgaaattgcctatgcggaccaaaatggcattagctacaaacgttaccatgagttcctaggtagctttatgcgcgactttgttagcatgggagttgctggagcgcacggaaaaacttcaacgacaggtatgttgtctcatgtcttgtctcatatcacagatactagcttcttgattggagacgggacaggtcgtggatcagctaatgccaaatattttgtctttgaatctgacgaatatgagcgccacttcatgccttaccacccagaatactctattatcaccaacattgactttgaccatccagactatttcacaagtctagaagatgttttcaatgcctttaacgactatgctaaacaaattaccaaaggtttgtttatctacggagaagatgctgaattgcgtaagattacgtctgatgctccgatttattattatggttttgaagcagaaggtaatgactttgtagctagtgaacttcttcgttcaacaactggttcaaccttcaccgttcatttccgtggacaagagttggggcaattccatattccaacctttggtcgtcacaatatcatgaatgcgacagccgttattggtcttctttacacagcaggatttgatttgaacttgttacgtgaacacttgaaaacatttgccggtgttaagcgtcgtttcactgagaaaattgtcaatgacacggtgattatcgatgattttgcccaccatccaacagaaatcattgcaaccttggatgcggctcgtcagaaatacccaagtaaagagatcgtagcaatcttccaaccgcatacctttactagaactattgccctgttggacgaatttgcccacgctttgaaccaagcagatgctgtttacctagcgcaaatttatggatctgctcgtgaagtagaccatggtgatgttaaggtagaagacctagccaataaaatcaataagaaacaccaagtgatcaccgttgaaaatgtttctccactcctagaccatgataatgctgtttacgtcttcatgggagcaggagatatccaaacctatgaatactcatttgagcgactcttgtctaacttgacaagcaatgttcaataggatttttctatggaaattccaattaagatcattcaggcaagtaagtctgatttggctgagatagagacacttcaggcctcatattttccagctgaaaagcagcaaccttcccatattttagaagaaagtatccgtaagtctgcggatacctttcttctagctagggatgaaaatcagcttctgggctatgttctaggtggtcctcagccccacaatccgaaatgtctagaaatacactctttagtcattgatactgaccatcagagacagggcttgggaacgcttcttcttgcggctttgaaagatgtggcagttaagctggattacaaagctattcgtttgaagagtccggatgagttgctttcctattttgaaatgaacggttttattgatgaagaagagacaaattcgctttatgcagctagtcaaggctttagtatgatttggtttaatctctttttttaggaggcacaatggaaattaggaaagcaagattagaagatttggatcgtatcgttgagattgaactagaaaatttctctgctgaagaagctattcctcgctctatttttgaggcgcatttgcgagagattcggacctcttttctggttgcagaaaaagaaggcagaatcatggggtatatagaagggccagttggaccgcaccgccatctgcaagatcagtcttttacagaagagatagaagattatagtcataagcctggtggttatatctctgtgacctgtctttctattgccaaagaatcacagggacttggacttggtaaaaaattactaacatccttgaaagaactggctcttgaacacgaaagagaaggcattaatctaacctgtcatgactatctcatcgcctactacgaaaagcatggatttgtcaatgaaggtaagtcccagtcaacctttgcaggggaaacctggtatgatatggtctgggaagctaaaaaataagctagaaaagcatgctaggttgcttttctttcgtttttaagatataatattatggattgtcaacgaggaggataaacttttgagtgaaaagccaagagaagacgaaaaattaagctttaaagagcagattttacgtgatttagaaaaagtaaaacgttatgaagggattcgtcaagaggccgctgaacttgatgaaaaaaaatcagctttgtctgtccctgacacaaaaattgctgatgaagaagtgatgaatgcatccctatcagctgttgaaaaaattatggagaatgcaccacgtgttccacagcatcctagtgaagatgtgcctgcatcaccggcggaggaactaagagaggaagctccaatcgttcctagtcaccctagtcaagatgttccagcttcaccagctgaagcaagtccatcaagaccggttccaggaccagatgtcaatcgtccacaaaaggtcgaaagagatttgaacacaactccaacaagagtagctgtttcttataaaactgaagaacaaaaagagacacaagcagaagcgccaagacctgaaccggtcgtcgaagcggaagctgttgacgtgatttctgaaactccacgtcgtagtcgtcgtgagacagttaaacctgtcaagaagaaaaaatcacatttgaaagctttcttcatttctctattgattttccttgccttgatttcagcaggtggttacttcggttaccagtatgttcaatcatctttattaccagttgatgcaaattctaaggaatatgtaacggttcaaatcccagaaggatccaatgtccaagagattggatcagcacttgaacattctggtgtgattaaacacggagtgatttttgctttttatgctaaatataagaattattcagatttgaaggctggatattacaatttgcaaaagagcatgagtacagaggatatcatcaaagaactacaaaaaggtggtactcctgaacctcaagaaccttcacttgcagatttgaccattccagaaggatataccattgatcaaattgcccaagctgtaggccaattacaaggtgaatttaaagaacctttgacagcggatgctttcttggctaaagtgcaagatgataactttatcagtcaagaagttgctaaatatccaaacctactcgaaagcttgccaacgaaagaaagtggagctcgttaccgtttggaaggttatcttttcccagcgacctactctatcaaggaaagcacaactattgaaagtttgattgatgagatgctggcagccatggataagaccttgactccgcactatagtgcaattaagtctaaaaacttaacagtcaatgaattgctaacaattgcttcacttgttgaaaaagaaggtgctaagactgaagaccgtaagttgattgcaggtgtcttctacaatcgtttgaaccttggtatgccacttcaaagcaatattgcaatcttgtatgcccaagggaaacttggccaaaatatcagcctagcagatgatgctggaattgacacatcgattaattcaccatacaatgtttatacaaaacctggtttgatgcctggtccagtagatagtccaagtcaggacgcgattgaagcaagtatcaaccaaacaaagagtgagaacctctactttgtagccaatgttacagatggtaaagtctattacgcagtgacacaggaagaacatgatcgtaatgtagctgagcacgtcaatagcaagcttactcaaaatagtagttcaaactaagactacaaaaatgagaatctcagatagagattcaatactatcgaaagaaagttgagaaaaatggcagaaaaaacatatcctatgacccttgcggaaaaggaaaaacttgaaaaagaattagaagaattgaaattggtccgccgaccagaagtggtagaacgcattaagattgcccgttcatatggtgacctttcagaaaacagtgaatacgaagcagctaaggatgaacaagcttttgtcgaaggacaaatctctagcttggaaacaaaaatccgttatgctgaaatcgtcaatagcgactcagttgccgatgatgaagtggcgattggaaaaacagtcactatccaagaaattggtgaggacgaggaagaagtttatattatcgtaggttcagccggtgcggatgcctttgcgggtaaagtttcaaatgaaagcccaattggacaagccttgattggcaagaaaacaggtgacacagcaaccattgaaacacctgttggtagctatgatgtaaaaatcttgaaggttgaaaaaacagcctaaaaacagaaaaaaggagtgaggaggcagtgcgcttcactcactcctttttccattttaaattgaattggagacgttatgagttcaaagaagaaaaaaaataagatggagcgtggtctgaccaatcgtcacgtgcaggttatggccattgcgggaacaatcggaacaggactctttttgggagcggggcgctctatcagcctaacaggtccttccattgtactgatttatatgattacaggggccttcatgttcctcatgatgcgtgcggttggggaaatgctctaccaagaccctgagcaacatacctttatcaactttatcacgcgccatttaggtaagggctggggttatttctcagtttggtcttactggctatccgttgtctttatcggtatggcggaaatcactgctatctctcactatgttcagttctggttccctagctggccaagttggatgattgagattggatttttgactattctagccttggtcaatttgattgcggtgaaactctttggggaagttgagttttggtttgcgatggtcaagattgtggctattttagccatgattgccacaggagtctttatggtcttgacaggctttaagacaccacatggagtagcaagtttggctaatatcgccgacaatttctcactatttcctaatggtggagttaactttgtcatggccttccagatggtgttctttgcctacctcatgattgagtttattggggtaactacttcagaaacaaaaaatccacgccaggtcttgccaaaagctgttaaggaaattcctttgcgtatcgtctttttctatggtggagctcttttagccattatgtctattattccatggcgtgaacttgcttcagctgattctccctttgttacggtgtttgaattggccggtatcaagtgggcggcagccttgattaacttcgtcgttttgacctcagcagcatctgctcttaactcaaccctttattcaaccggtcgtcatttgtaccagattgcccatgattcaccaaatccattcttaaaggctattaaggcagatactctttctcgtcataacgtgccacaaaatgctatcattgcttcagcaattttgattgccctagcagcctttatcaatgtcttgccaggtgtttcggatgcttttgccttgattacggcatcatcatcaggtgtctatatcgccatttatatcttgattatggtggctcaccttaaataccgcaagtcaccagactttatggcggatggctacctcatgccccactatcgtttcttaaatcctttaaccatgctattctttgcctttgtctttgtaaccctctttttacaagagtctacctttgtaggagcaatcggttcagctatctggattatcggtttcgggatttacagccagtggaaatttagaaaatagatttgaaactcatcaacttagcttggtgggtttttgctagtttgacagtctattgaaataagactataatcaagctgtatcagttttcgaggaggtttggatgtactttagattggaaaatgaggaatcccagaaagcacaagaaattgggaatttgattcgtgcttataaccgttccaaaagagaagaggctgaaagtgtgccacttaatctttatgtagaagatgaaaagggatatctcctggcaggtctggtagctgagactttcggaaattggttggaaatcgagtatttgtttgtaaaagaggaactgagagggcaaggaatcggttcaaaactattgcagcaagcagaaactgaagctaagaatcgaaactgtcgttttgcttttgtcaatacttaccagtttcaagctccagatttttataaaaggcatggctacaaggaagtctttaccttacaagactatccctacattgggcaaagatattattaccaaaaagatttgtaaggtgaatatgaaagtataaggcaaagaggggttcttgacataggtatgaaggggattctcgataaataccagttaaatcctacaaattgtgtctttctagacgatatggaggacagtacaatcgtagctgagacattagatgtgaaatcctacgatgctgtagatgttttgaaacaaattgaataagcagaaactctctatctttttttggtagagagttttttgttaataaaattttacaaaatgacatttataaattgcattaagttagatatatgatataatgttgttaaaaagaggcgcaactttttaaaactataaggaggacgcaggtggttaaaaatttaaaattaaaattagctcgggttgagcttgatttaacacaaggtcaactggcagaggctgttggggtgacgcgccagactattggtttgatagaggcggggaaatacaatcctagtctttccctctgccagtccatttgcagatgtttaggcaaaactttggatcaattattttgggaggaagaagatgaaaaatagatttttttattatcaattactagacgaaagagaagaacaactgatcaataaagcgggggctgaaagtttctatatctctatagctttcttgattttatcttatatgattgcagtattagcaccaagtctttttaatccgagaatgattctcatcactatcattattggaacttcttactttttcggccgtgctcgagattttggtgtgaactactatagtcgttttcattttacaattttagggtgtttgctggtaactctcgctattacgactcttttgatgttgcagaattatcaattcaacatagaaatttatcagcacaatcctttgaaccttaaatacttatctgcttgggtcattacttatctgatttaccttccttgggtttttatcggtaatctcggccttaaaagttatggcgaatgggctcagaaaaaatttgaacaagatatggatgaactggagagtggagaatagcttgttactcttttctcaatccagccaaaatgtgttataatagtactaatttattggaacacatgaaagttcttgaaattttcattggtttctagttaaggaagtaggaaaagtatgtatccagatgatagtttgacattgcacacggacttgtaccagattaacatgatgcaggtttactttgaccaagggattcacaataaaaaggcggtctttgaggtttatttccgccaacagccttttaaaaatggctatgcagtttttgcaggtttggaaagaattgtgaattatcttgaagacttgcgtttttcagatagcgatattgcctatttggagtcgctgggctatcatgggtcattcttggactatctccgcaatttcaagttggagttgaccgttcgttctgcccaagaaggggacttggtttttgctaatgaaccgattgtgcaggtggaaggccctctagctcaatgtcaattggtcgaaacggctcttttgaacatcgtcaactaccagaccttggtggcgactaaggcagctcgtattcgttcagtcattgaagatgaacccttgatggagtttgggacacgtcgggctcaagaaatggatgcagctatctggggaacacgcgcagcggtgattggtggtgccaatggaaccagcaacgtgcgtgctggtaaactctttgacattcctgtcttgggaacccatgcccatgccttggtacaggtttatggcaatgactatgaagctttcaaggcttatgctgcgacccacaaaaattgtgtctttcttgtggatacctatgacacccttcgcattggggtaccagctgccattcaggtggcgcgtgagctgggtgaccagattaactttatgggtgtgcggattgactctggggatattgcctacatttccaagaaagttcgtcagcaattggacgaggctggatttacagaggctaagatttatgcttcaaatgatttggacgaaaataccatcctcaacctcaagatgcaaaaggccaagattgatgtctggggcgtgggaactaagctgattacagcctatgaccagccagctcttggggcagtttataagattgttgcaatcgaagatgaaaatggccagatgcgcaataccatcaagctgtcaaataatgctgaaaaagtgtctacaccaggtaagaagcaggtgtggcgcattaccagtcgtgaaaaaggcaagtcagaaggagactatatcacttttgatggcgtagatgttgccagcatgacagaaatcaagatgttccatccgacctatacttacatcaagaagacggttcgtaattttgacgctgttcctctcttagtggatatcttcaaagacggaaaattgatttacaatctacctagcttgactgagattcaggattatgctcgtaaggaatttgacaagctgtgggatgaatacaagcgcgtgctcaatcctcagcattatccagtggatttggcgcgtgatgtatggcaagacaagatggacttgattgacaaaatgcgtaaggaagccctcagtgaaggagaagaagaatgagtttgcaagaaacgattatccaagagctgggtgtcaaaccagtgattgatgcccaggaagaaattcgtcgttccattgatttcttaaaaagatacttgaaaaaacaccccttcctaaagacctttgtattagggatttctgggggacaagactcaacattagcaggacgattggctcaactggccatggaagaactgcgagcagagacaggggatgatagctacaaatttatcgctgtccgcctgccttatggagtacaagccgatgaagcagatgctcaaaaagccctagccttcatccagccagatgtcagcttggttgtgaatatcaaggagtctgcagatgctatgacagctgcagttgaagcgacaggtagtcctgtttcagacttcaacaagggcaatatcaaggctcgttgccgtatgattgctcagtatgcccttgctggttcccatagcggagcagtcattggaacagaccatgctgcggaaaatatcacaggcttttttaccaagtttggtgacgggggtgcggatattctccctctttaccgcctcaataagcgtcaaggaaaacaacttttgaaggaacttggtgcaaatccagccctttatgaaaaaatcccaacggcagacctagaagaagacaaaccaggcctggctgacgaagtcgccctcggagtcacctatgcagagattgacgactacctagaaggcaaaataatcagcccagaagcccaagcaagaatcgaaaactggtggtacaaaggccaacacaaacgccacttacccatcaccgtatttgatgacttttgggagtgaaaacctccagtggaggttttcagcctctcatcttgaaataagaaagtgagagaaggtcctgtggacctttttaccctgagcctagaaatgagaaagcgaggaaggtcctgtggacctttttagattcttgccctgaaatcaaaaagaaagaaaaacctccagtggaggttcttaccccgagcatgaaaacaagtaagtgaagaaggtccgtgtgaccttcttcgcttattaccttgaaattcaaaagcaaagtaaatctaaattgaggttgggcagagaatcatctatcagaaagtgaggtagcgtaatgaaatctatcggtacgcagatattacagacagagcgtttaatcttgcgaagatttgtggaaagtgatgcagaagctatgtttcagaattgggcttcatctgctgagaatctaacctatgtcacctgggatccccattctaatgtcgaaatcactcgaaactcgattcgaaattgggttgcctcctatgctaatcccaactattacaaatgggccatttgtctcaaagaaaacccggagcaggtgataggagatatcagcatcgttgcaatagatgagaacgattcttcttgtgaaattggctatgtgctaggcaagaaatactggggtcatggtatgatgacagaggccttgaaagctgtcttggacttttgttttactcaagcaggttttcaagatgtcagagcacgatatgctagtctcaatccagcttcaggtcgtgtcatggagaaggctggaatgtcctatctcaagactattaccaatggtgtagagagaaaaggctatcttgctgaccttatttattatcagataagtagggaagactagtgaattttcttttctgtttccatcaaagtcagactgtgtctggctttttttgcaacattttttacataatctgattaaattcctatttttccctatcattgtccatgttttttcttgagttttggggctataatagtcctatcaaatcaaagaatggaggaaagcaatggataatataatcttttttatcagtgtttttcttgctggaattctctccttcttttctccttgtattttacccttgttaccggtctatgcaggggtcttgttggatgacaaagatggtgctcagacttctagtagcaaattttcaatctctgttgtcagtttattgcgaactctggcctttatagtgggtatttcctttatttttattttactgggttatggagctggttttttaggcaatttgctatatgcttcttggtttcagtatgtgacgggtgcggttatcattctcttgggcttgcaccagatggaagtcttacatttgcaggggctttacaaggaaagaaggctacaattaaagagacaggggcaaaagggtaagggctatagtcaggcatttttactgggattgacctttagttttgcttggacgccatgtgtggggccggttctaggctctgttttggccttggcggcttcaggtggtgctggagcttggcagggagctggtctcatgttggtttacacgctgggtttggcgctaccatttttagttctagctcttgcctccagctatgttttgaaacatttccgaaaacttcatccctatctaggaaccctcaaaaaagtgggtggtttcctcattatcgtgatgggaatcttggtgcttttgggaaatgcttccattttgactacattatttgaatagagaggaaaaagaaatgaaaaaatggcaaacatgtctccttggagtaggctcaatctgttgcttggcagcctgttctgctaaaaatatgtcagacgaatctactatgaaggagcaaacaaaaacagaacaagttagttcgcaaactgcgactaaaggtcaggcggttgctgattttgaactgacgggagtagatggcaagacttaccgtttatctgattacaagggcaagaaagtctatcttaaattctgggcgtcttggtgttccatctgtctagccagtcttccagatacagatgaaattgctaaggatgctggtgatgactatgtggtcttgacagtggtgtctcctggacacaagggggaacaagctgaagcagactttaagaactggtacaagggcttggattataaaaatttcccagttctaattgacccatcaggtaaacttttagaaagttatggtgttcgttcttacccaactcaagcctttatagacaaggaaggaaaactggtcaagacgcaaccaggttttatggataaggatatgattttaaagacattgaaagaaatggggtagagaaagatcatgaatgataaagtaaaattgtttgtcttggcaggaatctttttcctagccataagcggtttctattttctattgatgcgaaatgcagggcagacggatagctcgcaaattgagaaagcatcagttagccaaggaggaaaaacagtgaaaaaaacagaagtgagtaaagatgcagatttgcacgaaatttatctggctggaggttgtttctggggagttgaggaatatttctcacgcgttcctggagtgacagatgccgtatcaggctatgcgaatggtagaggggaaacaaccaagtacgaattgattaaccaaacaggtcatgcggagactgttcatgttacctatgatgctaatcaaatttctcttaaagaaatcctgcttcactatttccgcattatcaatccaactagcaaaaataaacaaggaaatgatgtgggaacccagtaccgtactggtgtttattacacagatgacaaggatttagaggtgattaaccaagtctttgatgaggtggctaagaaatacgatcaacctctagcagttgaaaaggagaccttgaaaaattttgtagtggctgaggattaccaccaagactatctcaagaaaaatccaaatggctactgccatatcaatgtcaatcaggcggcctatcccgtcatcgatgccagcaaatatcccaaaccaagtgatgaggaattgaaaaagaccttgtcacctgaggagtatgcagtcacccagaaaaatcaaacagaacgagctttttcaaaccgttactgggataaatttgaatctggtatctatgtggatgtagcaactggtgaacctctcttttcatcaaaggataagtttgagtctggttgtggctggcctagttttacccaacccatcagtccagatgttgccacctacaaggaagataagtcttacaatatgacacgcatggaagtgcgaagccgagttggagattctcaccttggccatgtctttacggacggcccacaggacaagggtggcttgcgctactgtatcaatagtctctctatccgctttattcccaaagaccaaatggaagaaaaaggctacgcttatttactagattatgttgattaagagggctttcctaagcagttagaggagaattttgctatactgatactagtaagtgacaaaggagagaagcatgacctatacaatcttaatcgtagaagatgaatatctggtaagacaaggattgaccaagctggtcaatgtagcagtctacgatatggaaatcatcggtcaagctgaaaatggaaggcaggcttgggaattgatacaaaagcaggtgccagatattattttaaccgatatcaacatgcctcagctaaatgggatccagttggccagtctggtccgagaaacctatcctcaggtgcatttggtctttttaacaggctacgatgattttgattatgccttgtctgctgtcaaactaggtgtggatgattacctactcaagcccttttctcgtcaggatatcgaggaaatgctggggaaaatcaagcaaaagttggataaggaagagaaagaagagcagttacaagatttattgactgataagtttgagggaaatatggcccagaaaatccagtcccatctggctgatagccaatttagtttgaagagtttggccagtgacttgggttttagcccgacttatctgagttctttgattaagaaagagttaggcctgccttttcaggattatctggtgagagaacgtgtcaaacaagccaagcttttgcttttaactaccgatctgaagatttacgagatcgcagagaaggttggctttgaagatatgaactattttacccaacgttttaaacagattgcaggtgtgacacctcgccagtttaagaagggggaagatcgatgaaacgttcttctctcctagtcagaatggttatttccatctttctggtctttctcattctcctagctctggttgggactttctactatcaatctagttcttcagccattgaggctactattgagggcaatagccaaacgactatcagtcagactagccactttatccagtcttatatcaaaaaattagaaaccacctcgaccagtttgacccagcaggcagatgtcctaacctatgctgagaatcccagtcaagaaaaggtcaagggaattcgagatttgtttttgaccattttaaagtcagaccaggacttgaaagctgttgtgctggtaaccaaatctggtcaggtcatttctacggatgatagtgtgcagatgaaaacttcctcagatatgatgactgaggattggtaccaaaaggctattcatcagggagctaaaccagttttaactccagctcgtaaatcagatagccagtgggtcatttctgtcactcaagaacttattgatgcaaagggagctaatctgggcgtgcttcgtttggatatttcttacgaaactctggaagcctatcttaaccaacttcagttgggtcagcagggctttgcctttatcatcaatgaaaaccatgaatttgtttaccatcctcaacacacagtttatagctcatctagcgaaatggaggccatgaaaccctacatcgagacaggtcagggatatacccttgaccacaaatcctacgtcagtcaggaaaagattgctggaactgattggacggtgcttggcgtgtcttcgttggagaagttagaccaggttcggagtcaactcatgtggaccttgcttggagccagtttcacatctcttcttgcttgtctctgcttggtgtggtttagtcttaaacgctggattgcccctttgaaggatttgagagaaactatgctggaaattgcttctggtaatcagaatcttcgtgccaaagaagcgggtgcttatgaattgagagaggtgactcgccagttcaatgccatgttggatcaggttgatcagctgatggtagatattcgcaggcaggaagaaacgacccgtcagtaccaacttcaagctctatcaagccagattaacccccatttcctctataacaccttggacaccatcatctggatggctgaatttcaagatagtcagagagtggtgcaagtgaccaagtccttggcgacttatttccgcttggcgctcaatcagggtaaagatttgatttgcctgtctgatgaaattaatcatgtccgccagtatctatttatccagaaacaacgctatggcgataagctggaatacgaaattaatgaaaatcctgcctttgataatctagtcttgcccaagctagtgctacaacctcttgtagagaatgctctttaccatggcattaaggaaaaggaaggccagggacatattagagtttctgttcagaaacaggattcgggattggtcatccgcattgaggatgatgggattggtttccaagacgctagcgatagtagtcaaagtcaactcaaacgtgggggagttggtcttcaaaacgttgaccagcggctcaaacttcattttggagaagattaccaaatgaagattgattctgtcccctcaaaagggacgacagttgaaatatacataaatagaatagaaactagttaactcccagtcaattctgggagttttatgcgtaattgggcaagctttctaggttgtctatcttgctaaaacgtagaaaaaacgatatgatagataatgacaaaagaggtatcaagtatgaaggaaaaagacattcaaagagaaacaagccagattgtaaaagatgtattagaaaaggccaatttgaagcagggatctatctttgttttgggcctttcttctagtgaagtgataggtggtcagattggcaaggaatccagccaagaaattggggaaatcattgtgaagaccatcctagatatcctagaagaaaatggaattcatctagccgttcaaggttgtgaacatgtcaatcgggccctcgtcgttgaacgtcaggtggcagagcagtttggtctggaaatggtcagtgtccttcctacccttcatgcaggaggttcaggtcagttggcagccttcaagtttatgcaagatccagttgaggttgaatttatcaaggctcatgctggattggatatcggagacactgcaattggcatgcatgtcaagcatgttcaggttccgattcgccctcttttgagagaaattgggcatgcccatgtaacggctcttgctagccgtccaaaattaattggaggtgcgcgtgcgcattatccacaagattctatcagaaagtcgtgagaatgaaaaaaacaaaacaacaactagaaaaaatcaccaaatattcgattcgtaagctaactgttggggtaggtcctgtagccatcggggccttcctttttggtgctagtaccctttcagtagataaggttcaagccaatgaagtcggcggtgctcatagcgttcattaccgttatttggcggagcaggaattgaccgagtctgaaaaagccctgattcaccatgaagttcctacagaatttcaagatgatgatattctttatgtagtttatcgcaagaaggcaactaccagtcaacaacttccttatacaggaagtaaggaactagctttggcaggtcttggcttggcaacggcttctctagcagtctttttggtgtccaaaaaaggtcgtagagaagttctaggtgttctcttgattggttctttaggagccagcacctttgtaccttatgggacattcgcatttgaaaataaagaattgctttcttataaccaaactatttcagcctctacacatgaaggcttggctgaagggattatccatattgatggctatgaatacattggctacttcaaggaagcagaactccatccatcaagaccagcttcagctgaacagactcagttgccagtagagaagcaaagttcaaaagaaatcgagaaaactgaagtcgttcaagaaagacctgctgttgctccagaaactatcgttgagaatcctgtagtagagaatccagttgctcctgctattgaagaaaaaccagtttctgagaagcctcagacaagacaggaagagagcttggtggagattccgtttgaaacagtcacaaatccagatgcgaatctagcagaaggacagactcgtatcgtcgcagctggagtaaatggtcagcgtcgccttgtaagcaaagtttcgatggtcaacggtcaagaagttagagaagtcatcgaagaccaagtagtccaaaatcctgtgtcgcaagtcattgcagtcggaactaagaaagaggtgcaacctgctccaactccagtaccacaagctgaaccaagtcaccaagtagctaaaggtacacaagaagaaggtaagacaggacaatccttaacgcaaccagaattgccagaggcttcagtagaagcaaaaggaacccaagaagaaggtaaagaaggtcaatccttaacacaaccagaattgccagaggctccagtagaagcaaaaggaactcaagaagaaggtaaggcaggacaagctctaacacagccagaattgccagaggctccagttgaagtaaaaggtacacaagaggaaggcaaagcaggtcaagctcttgtacaagaaccgttacctgagtacaaagtaactgagggaacccttgttgaaacatcgactacagacctagactacaaaactgaaacgactgaggatccaactaagtatacggacgaagaaactgtcgtaagaaatggagaaaaaggtagtcaagttactaaaacaacttataaaacagtagaaggtgttaaaactgaccaagttctttcaactagcacagaagttgccaaggagcctgtaaaccaacaggtaagtcgtgggataaaaccaattgaaggaactcttgtagaagaaagtcttgaaaagattccatttaaggaagttgttaaagaagatgaccaactgaaaaaaggcttagaagttgtagctcaagaaggaaaagaaggccagaaaaaaatcaccaagacctttaataccattaagggagttaaaacagaggacgctccaaaagttacagaggaaatccttgaggcacctcaagacaaaattttgaaacgtggtactaagaactttgaaaagccagtattgaccatcacagcagttgaacctaaggatttgaaacgtacttcagatgttaagtatagtctagaaaatccaagtaaggcagtcattaaatctatcaccctaactctgaaaaaaggtgatgagattgtcaaaactttgaatgtttcgccagaagacctaactgctaatttaacagatttacagtactacaaggattataaacttgaaaccaagatggtttatgaccgtggtgagggtgatgaagaagaaattctgaaagaagaacctctaagaattgacctcaaaaaagttgaaatcaagaacatcaaagaaacaagcttgatgagtgtagacgctgatggtaatgaaacagatactagtttattgacagcaaaaccagctgatgttgctccactttatttacgagtgaccactcatgacaataaaataacaagactggctgttgacaagattgaagaagtagaaaaagacggaaaaactttatacaaagttactgccaaagcacctgatttgattcaacggaatgctgacaacacactgaacgaagagtatgttcattactttgaaaaacaaaaaacacacgaaggtgatgtatattatagctttgacgaccttgtaaaagctattcaaaaagacccgactggtacatttaagcttggtagcaatatcaatgctgctaacgttaaaccagcaggaaaatcttatgttactaatgctttcaaaggaacattgacaagcactgacggtaataaatttaccattagcaatatgaacagacctttattcggtgatattgtcggtggtactgttaaagatttactacttgaaaatgtaaatatcgacatgccagggactgataggattgcaccgctagcgaatgttatcaaaaataatgcgactgtagagaacattaaagtaacaggtaacgttgttggtaataatgatgtatctggtgttatcaataaaattgatggtagtggaaaattaagtaacgttgcatttatcggtaaagtacacgctgctggaaatcgcggtggttacttaacaggtatcgtcggtgaaaactggaaaggtattgtagaaaaagcttatgttgatgctgaaatcacaggtaacaaagctaaggccgctggaatcgtatattcatctcaaaacggtggcaacaacaatactttaggtaaagaaggtactcttcgaaactctgtagcaaaaggctctattgaactcaaagaagccgttatgtctggtggactgctagggactaactgggcactaggggctatagaagacaacatcactatgatgaaagttaagactggtgaaatggtctttggtcattctgatattgatgctgatgattactttacatactctagaacgaagcgcaattacagtgttgagggtgtaagtgaaggtaaaacaacttataataattctaaaaaaattcctagcataactaaagaaaaagctgatgaattaatctctaaaatgggaatcactgctgataaatttgaaagcacacttcctgttgaagataaactgaacaatattgtaagtaaagctaatcaatacaaaaatattgatgactacgatgcttctcgtgagcttgcttaccgtaacatcgaaaaacttcagccattctataacaaagaatggattgtcaaccaagggaacaagcttgcagaaggttcaaacttattaacgaaagaagtcttgtctgttactgcgatgaaaggcaatgactttgtcacagaccttacagatgctgaccatattttggttcactacgcagataagacaaaagacatctttacaatttcaccgaaagaatctaaagtgaaacaagtgaaagaatacagcgtggctgaattgggtgaagtcgtttatacaccaaacatggttgttaaagatcgtacagatttaatcagcgctatcgaaagcaagttaagtccagtagaattacaatctgagccgatttaccaacacttgggtagaactggtggcaacaaagtcaatgcaattaaagatttgtacttagaagaaagcttcaagtatgttaaagataatcttaataaattcgttacgaagttagttgaaaatgaagatcaccagcttaacactgatgaagctgcaaaacgtgccttgattaagaaaatcgatgacaataaggccgcagttcttcttggtttgtcttacctcaaccgttactacggagttaaattcgatgactttaatattaaagaattaatgctattcaaacctgacttctatggtaagaatgtaaatgtgttagacttcttgattaaggttggttctaaagaaagtaacattaaaggtgatagaactttagaagcttatcgcgaaacgatcggtggagttattggtataggtgagttaaacagtttcttagactataatatgcgtctattcacaagtgacacagacttaaacgattggttcataaaagctactaaagataatgtatatatcgttgaacctaaaacaacaactcctgaatttgctgataagaaacacagagcatacgaaggattaaacaacgatgttcacggtaagatgattttaccacttcttaacttaaaagatgcgcatatgttcttaatctcaacatataacactatagcatacagttcatttgagaaatacggtaagaatactgaagccgaacgtgaagcattcaaagctgaaatcaataaagttgctaaaggtcaacaaaattacctagatttctggtctcgtctatcattggataaagttcgcaaccagctgcttaagagcaataacatggtgccaacaccagtacttgataaccaaaactataaaggaatcagcacagataaatatggatatacgaatagtggtaaggatgtagcgcctatccgtgaattgtacggaccaacaggtcgttaccacgcaactgactggcgtatgggagctgtagctcgtatctacggtaatccatataaagatgattcagtcttctttatggtgacggatatgattagtgactttggtatctcagccttcactcacgaaacgactcacgtaaatgaccgtatggtttatttaggtggttcaagacaccgtgaaggtactgacctagaagcatttgcacaaggtatgctgcaatcacctgctgaaacaagtccaaacggtgactttaaagcactaggattgaacatggcctacgaacgtccaaacgatggaaaccaatggtacaacactaatccaaatgaccttacttctcgcgctgaaattgatcattacatgaaaggtttcaatgatacgcttatgcttcttgattatcttgaaggagaagctgtaattgataaaggcagtaaagaactaaacaacgcttggttcaagaaagtagataagcaacttcgtggagctaatacgaagaaccaatacgacaacgttagagatttaaatgcagaagaaaaagaatataatttaacatctgttaacgacttagtagagaaaaacttcatgaccaaacacggtcctggtaatggtcagtatgatccaactggatttggctctgcctatgtaactgtaccaattacagctggtatctatggtggtaatacgagtgaaggtgctccaggagcaatgtcattcaaacataacaccttccgtatgtggggttactttggatatgaaaaaggcttcctaaattatgcttctaacatgctgaaaaatgagtctaaacaagcaggtcatgctactctaggagatgacttcatcattaagaaagtttctgatggtaaatttaatactctagaagattggaagaaagaatacttcaaagaagttgttgataaagcgaaagcaggatttaaccctgttacaatcgacggtactacatacagtagttacgatgacttgaagaatgcatttgttgctgccgttgataaagataaagcaactcttaataatggttcagttaaatttgataataccgtatcacttaaagagaaaatcttcaagaaacttcttcaacaaacaaacagctttaaaacttcaatctttaaataattttgttagtcctgaagggactgacttaatctcaaaaaggagaggcaagtatgtcttctcctttttatttatgtagtgattgactgttcatttacaagcataattattgaatatatttataactaaaatactagaaaatagattttcaaaaagtaaatgaaatgtcaggcagggctttgttttatggattctgttctagttcaaacaacttgcaaaaatagcttaaaaattataaaattaaatataaagtaatttgtaaatacgcataaagtttaatatgatataatgtgtatacagataagagaaaaggaaatattataaatgaagaacaagctttctgataagtcccttgagaatcagagaaaagaaaaaatcatgcgtttctccattcgtaaatatagttttggtgcagcgagtgtagcggttgctgcctttttaatgtttttaggaaatggagcagttgcagctgatcaattgaaagtaactgaagagtcttctagtaaagtagagttggctcaatcaggtggggagaaggctgaaaatcagagtgagtccaaaatcagtgagccaaaaattagtaaaccagaattagataaaagccaacttgcaaattatattggtgaaattgaaggtaagatttcaagtggagcctacgctaataagacagaggaaagtgtagcgagtctagctgctgaattggctaatgccaaagcaactttagcgaacgcaagcagtcaagaagaattgacgagtgcctatcaaaaactggttgctacagttaactcaaaattacgaaataagctggttgagaaaaaagaaattgtttcaacagatacaactgaaggtaaagaaacagttggtatcaaagctgataatactgagaaaccatcagaatcaaatgcgattgaaaatactggtgccaatgatccacgtaatgggagtgaaattgaaaaggatacaacattccgtgcagctgtgaatcaagatcctaaggtagactttacattctccataccagatgagaagaaaatctatatctataacgaagagcatttctcattagaaattcctgtttattctgaaactggaaagattcgttatgcaacgattaagaaaggatctagacaaagattccctaatgttgcaggtacagataatgacttggatgttgaatttggatttactgctagggtaataaatcgtgctgaaacggcaggggtaacatcggaggcgagtcaagcaaatcctgcgaaaatcgttattacaggtcgtccaaacgatatactgaaaaaacacagagattatacaaaacaagaaaaccaaacacttaacgtgggtactcgttatattcaggtggttgatgatcaaggtagagagaatcttaaaaaaggtgatagtattgcagacccagggtatttctacttagtattaaaagctcaatctaagaaatattcattaagatctcaacctacagatgaaaagatttctgtaactagtttgacaaatcctacagcagaagacttgcaaaaaatcaaagatagtattcaactagaatattcaacaacaaacgaagatgcacgatttgctgataaacgtggaactttagttgaacatcctgaggatgttatccaatctgttaatatcgttgggaataatatcgttgtgacatttacagatggttctacgaagacaaaaccagtaagtgaaattgtacaaaaaaatgttccgccggttgttaatctaccgtattcaaacgaagcgaacagaaatatttatatctattctggagaagagacagacctaacatttactgcaacggatgagtctaagattaaggacctaaaacttcgtggccctggtgacattaactataataatgcaactagttttggtttagcagtagggaatattgttgatagcgcagtaacaagcggagcgggttctgtttctgaagataagaagacagcaaccattaaaatgactggaacaacgaatttaactgctgggaaaaaatggacaagtgttatcgttgcaaaagatgacaacaatggagaaagtgcaccttttaacggaagaattaatgcaactactaatcctgcagaacgtcaaaaaattgaaggttatgttgaatttgttgtaaaaaatcaaactactaaatatgatattaagactccagaaggaacagttagtgtagtagatccagcgaatgttacggctgacgaatttgaaaaaattaaagaaaaagtaaaaatcgaatactctcaaactaacgatgatgctaattttactagcaagagaggacaagctgtagacaatcaggcgacaagaatttctacgattacaaaagatgctaatggaaatcttgttgtgacctataaagatggttcaactgatacaaaacctttatcagaattcacaagtttaaataaacaacctgcaattgatgcggttaacaaggctgctgaagataaaattgcagagattaatgctaatacaaacgcaactgcagaagaaaaagcagctgcaatcgaaaaagttaatgccgataaggcgaaagctttaacagcaattaatgataactcggtaacgacaaaagcagcattagataatgccaaaacatctgggacaacagcgattagcaatgataatcctgtagtaacgaagaaaaatacggcaaaagcagctattgactcagctttaagagcgaaagaagcagccatcgatgcgaatgacgacttaacgacagaagagaagaatgcagcaaaagcagatgcacaggcaaaagcgaatgcagcaaaaacagcaatcgataatgcaacaacaaacgtagcagtggactcagcccaaacggcaggaacaacaagtgtaagttcagtaatgccaacagcggtagcgaaaccagcggctaagaaagcaatcgaagacgcgctgaaagcgaaagtagcacaacttgatgcaagaaatgatttaacaactgaagaaaaagaagcagcaaaagcagatgcacaagcaagagcaacagcggctaaaaataatattgatactgcaacaacaaactcaacagtagataatgcgaaaactacaggcgttgctgatgtagaaagcgttaatccgcaagcaagccaaaagaaaactgacgcaaaaaatgcagttgatgaagcgttaaaagcaaaagaagcagagattgatgccaataacgatttgactgctgaagaaaaatccaaagctaaggaagacgcaaaatccaaagcagatgtagcaaagcaagccatcgacaacgcgacaacaaacgatgcagtaactcaagctaaaaacgctggggcaatatcagtagattcggtgactccaacgccggtagccaaaccagcagcgaagcaagccatcgatgacgcattaaaagctaagaatgacgcaattgatgccaacaacgatttgacagacgaagaaaaagcaaaagctaaggaagacgcgaaagcgaaagcagacgcggcgaagcaagcaatcgacaacgcgacaacaaacgatgcggtagaacaagctaaaaatgacggagcgacaagtatatcttcagtaactccaacaccaacagctaaaccggctgcaaaacaagccatcgatgacgcattgaaagcaaagaatgacgcgattgattccaataacgatttaacggctgaagaaaaagccaaagctaaggaagatgcgaaagccaaagccgacgcagcgaaacaagcgatcgacaacgcgacaacaaacgatgcagtaactcaagctaaaaacgctggggcaacatcagtagattcggtgactccaacgccggtagtcaaaccagctgcaaaacaagccatcgatgacgcattgaaagcaaagaatgacgcgattgattccaataacgatttaacggctgaagaaaaagccaaagctaaggaagatgcgaaagccaaagccgacgcagcgaaacaagcgatcgacaacgcgacaacaaacgatgcagtaactcaagctaaaaacgctggggcaacatcagtagattcggtgactccaacgccggtagtcaaaccagctgcaaaacaagccatcgatgacgcattgaaagcaaagaatgacgcgattgattccaataacgatttaacggctgaagaaaaagccaaagctaaggaagatgcgaaagccaaagccgacgcagcgaaacaagcgatcgacaacgcgacaacaaacgatgcagtaactcaagctaaaaacgctggggcaacatcagtagattcggtgactccaacgccggtagtcaaaccagctgcaaaacaagcaattgatgacgcattgaaagctaagaacgacgcgattgatgccaacaatgacttaacagacgaagaaaaaactgcggcgaaagctgatgcaaaagccaaatctgacgcagcgaagcaagcaatcgacaaggcgacaacaaatgatgcagtaacgcaagctaaaaacgacggagcaacatcagtagattcggtgactccaactccggtagccaaaccagcagctaagaaagccatcgatgacgcattgaaagctaagaacgacgcgattgatgccaacaatgacttaacagacgaagaaaaaactgcggcgaaagctgatgcaaaagccaaatctgacgcagcgaagcaagcaatcgacaaggcgacaacaaatgatgcagtaacgcaagctaaaaacgacggagcaacatcagtagattcggtgactccaactccggtagccaaaccagcagctaagaaagccatcgatgacgcattgaaagctaagaacgacgcaattgatgccaacaacgatttgactgctgaagaaaaagccaaagctaaggaagacgcgaaagtcaaagccgatgcagcgaagactgcaatcgacaaggcgacaacaaatgcagcggtggaacaagctaaggctgatggagcgacaagtgtatctttagtaacaccaacagcgcaagcgaagccagctgcaaaacaagccatcgatgaagcattaaaagcaaaagaagcagcaatagatgccaacaatgacttaacagcagaagaaaaaacaaaagctaaagaagatgcgaaagccaaagcagacgcagcaaaacaagcaattgatcaagcaacaacaaatgcatcggtagaacaagctaaaaatgatggaacaacagaagtaaacaatgtgaatccaacagcgcaagcgaagccagcggctaaaaaagcgatcgatgacgcgttagttgataagattaaagaaatcgaagcaaataacaacttaacagacgaagaaaaagccgcagctaagcaagaagcgcaagccaaagcagacgcagcgaaacaagcaatcgacaacgcaacaacaaacgatgcagttgagaaagctaaaaacgatggagtgacaagtgtatcttcagtaagtccaacagcgcaagctaagccagcggctaaacaagcaatcgacgatgcattaaaagctaaggaagcagcaattgacgcaaacaacgacttaacagacgaagagaaaactgcagcgaaagctgatgcgaaagcaaaagcagacgcagctaagcaagccatcgacaacgcaacaacaaacgatgcagttgagaaagctaaaaacgacggagtgacaagtgtatcttcagtaagtccaacagcgcaagctaagccagcggctaaacaagcaatcgacgatgcattaaaagctaaggaagcagcaattgacgcaaacaacgacttaacagacgaagagaaaactgcagcgaaagctgatgcgaaagccaaagccgacgcagcgaagactgcaattgacaatgcaaccacaaacgataccgtaacgcaagctaaaaacgacggagcgacaagtgtatcatcagtcactccaacaccaacagctaaaccggctgctaagaaggccatcgaagatgcgctgaaagctaaggaagcagcaatcaacgcaaataatgacttaacagacgaagaaaaagccaaagctaagcaagaagcgcaagacaaggcagctgcagcgaaacaagcgatcgataatgcgacaacaaacgcgggagtagaccaagctaaggctaatggaacaacagaagtaaataatgtaaatccaacagcagtggcaaaaccagcagctaaaaaagcaatcgacgatgccctaaaagctaaaaatgacgcgattgatgctcgagataatctgacagctgaggaaaaaatagcagctaaggaagaagctaaagccaaagccgacgcagcgaagactgcaatcgacaacgcaaccacaaacgatgcagtaactcaagctaaaaatgatggggcagcaagtgtatcttcagtgactccaactccagtagccaaaccagcagcgaagaaagcaattgatgatgcgctaaaagctaagaacgacgcaatcgacgcaaataacgacttaacagatgaagagaaaacagcagcgaaagctgatgcgaaagcaaaagccgacgcagcgaaaacagcgattgacaacgcgacaacaaatgatgcagtagaaaaagctaaaaatgatggagcaacatcggtagattcggtgactccaactccagtagcgaaaccagaggcgaagaaagcagtagaagatgcacttaaagccaaagaagcagaaatcgatgctcgagatgatctgacagctgaggaaaaaacagcagctaaagaagaagcgaaagccaaagcagacgcagcgaagactgcaatcgacaatgcgacaacaaataatgcagtaactcaagctaaaaacgctggagcaacgagtgtatcttcagtaaatccaacagcgcaagctaagccagcagctaagaaagcaatagacgatgcgcttaaagctaagaacgatgcaatcgatgtgaacaataatttaacagctgaagaaaaaacagcagcgaaagctgatgcgaaggcaaaagccgacgcagcaaaacaagcaattgacaacgcgacaacaaatgctgacgttgagaatgcaaaaactactggagtggcagatgtaaactcattgaatccagtagcggttaagaaaccagaggcgaaaaaagcagtagaagaagctcttaaagcaaaagaaacagagattgatgcgaacaatgacttaacagcagaagaaaaactagcagctaaggaagaagctaaggcaaaagcagatgcagctaagaaagcaatcgatggagctgatacagatattaaggttgatgtaaatagtatatctggtttaagtgatgtaaattcatttagtccagaaccagttaagaaatcagaagctaaaaaagctgtagatgaagcactaaaggcaaaagaagcagaaattgatgcgaataatgacttaacagcagaagaaaaattagcagctaaggaggaagctaaagctaaagccgatgcagctaagaaagcaatcgatgaagctgatacagatattaaggttgatgtaaatagtatatctggtttaagtgatgtaaattcatttagtccagaaccagttaagaaatcagaggctaaaaaagcaattgatgcagctctagagaagaaaatagaagaaatcgatgctcgagatgatttaacaactgaagagaaaactgcagcaaaagctgaagtagaaaataaagctaatgaggcaaaagacgcaatcgatgcagcagatacagacattaaagtagatgtaaatagtgtatctggtttaagtgatgtgaactcgtttagtccagaagcagctaaaaaaccagcagccaaacaggcaatagatgatgcattaaaagcaaaagaagatgcaatagatgcgaatgatgatttaacagctgaagaaaaaactaaagccaaagcagaagctaaggcaaaagctgatgcagcgaaagaagcaatcgacaatgcgacaacaaacgcagaagtggaacaagctaagactgcaggaacggcatcagtagcttcagtgactccaaagccagtggcaaaaccgactgcgaagcaagccatcgacgacgcgcttaaagctaagaacgacgtgattgactctcgtacagacttgacagatgaagagaaagctgcggctaagtcagaagcaaaagctaaggccaacgcagcaaaagcagccatcgataatgcaacaacaaatgcggaagtagaccgagctaaggtgactggaataacagaagtaaaagcagtagatccacaaccagaagcgaagccagaagctaagaaagccatcgatgataccttaaaagctaagactgatgaaatagactctcgtacagacttgacagatgaagagaaagctgcggcgaaagcagacgctaaagcgaaagctgatgcagcgaagactgcaatcgacaacgcaacaacaaacgatgcagtaactcaagctaaaaacgatggggcagcaagtgtagcttcagtaaatccaacagcgcaagcgaagccagcggcaaaacaagctatcgatgatgcattgaaagctaagaccgacgcaattgatgccaataacgatttaacagcagaagaaaaagccaaagctaaggaagacgcaaaagcgaaagctgacgcagctaagcaagccatcgacaacgcaacaacaaacgatgtagtaactcaagctaaaaacgatggggcagcaagtatagcttcagtaaatccaacagcgcaagcgaagccagcggcaaaacaagctatcgatgatgcattgaaagctaagaccgacgcaattgatgccaataacgatttaacagcagaagaaaaagccaaagctaaggaagacgcaaaagcgaaagctgacgcagctaagcaagccatcgacaacgcaacaacaaacgatgtagtaactcaagctaaaaacgatggggcagcaagtgtagcttcagttactccagcagcagtagtgaagacagcagctaagcaatccatcgacgaagctctgaaagctaagaatgatgaaatcgacgctcgtacagacctaacagatgaagagaaagctgctgctaagtcagaagcaaaagctaaggctgacgcagtgaaagcaaccatcgacaacgcaacaacaaatgcagaagtagaacaagctaaggtgactggaacaacagaagtcacttcagtcaatccagaggcgttgactaagtcagcagctaagcaatccatcgacgaagctttgaaagctaagactgatgagatagacgctcgtacagacttgacagatgaggagaaaactgcagctaagggagacgcgaaaacaaaagctgacgcagcgaagactgcaatcgacaacgcaacaacaaacgatgcagtaactcaagttaaaaacgatggggcagcaagtgtagcttcagtgactccagcagcagtagcgaagacggaagctaagcaagccatcgatgaagctcttaaagctaagagtgctgagatagacgcacgtacagacttaacagacgaagagaaaactgtggctaaattagatgcaaaagccaaagctgacgcagcgaaagcaaccatcgacaacgcaataacaaatgcggaggtagaacaagctaaggtgactggaataacagaagtaaaagcagtagatccacaaccagaagctaagacagcagctaagcaagccatcgatgatgccctaaaagctaagaacgacgagatagacgctcgtacagatttaacagacgaagagaaaactgctgctaagtcagaagcaaaagctaaggccgacgcagcaaaagaagttatcgataaagcgacaaccaatgcagaagttgaccaagcaaagtcaactggaattgcagaagtcacttcagtaaatccaggtgcagtggctaagacagaagctaagcaagccatcgacgaagctctgaaggctaagaacgacgaaatcgacgcacgtacagacttaacagatgaagagaaagctgctgctaagtcagaagcaaaagctaaggctgacgcagcaaaagaagccatcgacaaagcaacaacgaatgcagcagtcgaccaagctaaaactaacggaactttagaagtcacttcagtaaatccagaagcagtagcgaagacagaagctaagcaagccatcgacgatgctttgaaagctaagactgccgaaattgatgctcgtacagacttaacagatgaagagaaaactgcagccaaagcagatgcaaaagccaaagctgacgcagcaaaatcagccatagataaagcaacaacgaatgcagaagtctaccaatctaagtcaactggaatcacagcagtgacttcagtaaacccagaggcagtagcgaagacagaagctaagcaagccatcgacgaagcgcttaaatctaagactgatgaaatcgactctcgtacagacttaacagacgaagagaaaaccgcggctaaagcagaagtaaaagataaggctgacgcagcaaaatcagccatagataaagcaacaaagaatgcagaagtcgaccaatctaaggcaactggaatcacagcagtgacttcagtaaacccagaggcagtagcgaagacggaagctaagcaatccatcgacgaagcgcttaaagctaagacttccgagatagactctcgcacagacttaacagaagaagagaaaattggggctaaggcagaagcaaaaacaaaagctgacgcagcgaagactgcaatcgacaacgcaacaacaaatgcggaagtagaacaagctaaggtgactggaacaagagaagtaaataatgtaaatccagacgcagtagcaaagtcagaagctaagaaatccatcgacgaagttcttaaagctaagactgccgagatagacggacgtacagacttaacagatgaagagaaaactgcagccaaagcagacgcgaaagctaaagctgacgcagcgaaagcagccatcgacaaagcaacaacgaatgcaacagtcgaccaagctaagtcaactggtattgaggaagtgaactcagtcaatccgattgcacaaattagaccggcagttggagcaagtgctggagttcatgtaaactcagctaatccaacttctaaagaaaaaccacaggaaaaacaagcaatagaccaagtattgaaaactgatgaagccaaagctaaagtgaaagatagtgtagcatctactatctcacaacttgaaaatgagaatcagcaagtagctactaatcagcgtgtagtggctagagaattgccaaatacaggtacaacagaatccataacagcaattgttgcagcaacagctagtgcgatacttggttttggtcttattgctcgtcgtcgaaaagaagatgaagaagacaaattagaaaatcagtaacgatttctaacagttgcaactccttttttgagactaagtagataatattattcttaaaactctcctagagcaaaatagctactaggagagttttttctctaatcagaagatacgtgacgggactaaaaacaatctcatctgctttgcggatgagggttttcttattttgtgctatacttaagatatgcatagaaaaacagtgattgattttagggctttgggcgagagatacacctttacccagcctattaaagagttgaaaacgagaaatgtagcagaagtggcagatttgctggtacaagtggaaagctaccaagagcaaggctactatgtggtgggctatgtcagctacgaggctgcacctgcttttgaggagaaattagcagttcataaagctcctttactggacgagtatttgctttactttactgttcacgatagggtggagacatctcctattcccctgacttatgatgaggttgatttgccttcaaattggcaggaagtgacgtctgaagcagattatgaaaaggcgattgctcagattcaccatcatttgcggcagggggacacctatcaggtcaactacaccgtccaactcaagcaaaaattaagtgccaatccttttgccatctacaatcgtatggtagtagagcaggaggcgggctacaatgcttatgttgaacatgacgagatggcagtgatttccatgagtccagaactcttttttgagcaaaatgaccgcgagttgacaacacgaccaatgaagggaacgactcagcgtggggtaactgaccaagaagatcttgaacaggccagttggttggagcaggattctaaaaatcgctctgaaaatatgatgattgtggacctcttgcgcaatgacatgaaccgtatttctgaggtggggagtgagcatgtagagcgtctttgccaagtggaacagtattcaacggtttggcagatgacttcgaccatcaagagttggttgcgagaggatgttgaccttgtagagatattccgttctctatttccttgtggttccataacgggagctccgaaaattgcgactatggaaatcatcaaggacttggagccacaaccgcgcggagtctactgtggaacgattggtctcctgcttccaaatggacgacgaattttcaatgttgctattcggaccattcaactgcatcaagggaaagccatctatggagttggcggaggcattacatgggatagcacttgggagtctgaataccgtgaggttcatcaaaaggcggcagttctttatcgtaaacaagctcgtttcaaactgattactacagggaaaatcagccagaagaacttgctgtttgaagaacaacatatagaaaggctgagaaaagctagtcggtattttgcctttccatttgattcagaaaacttgaaacaaaagatagaggaagagtgtcaggcttgtgatgctaatcaagattaccgcttgcatatttctctcgacaagtctggagagatagaagtagatcgtcaagtattaacagctcttagtccaagtttttgtcaggccaaactttgccttcaggaagccaatttgcaacaagcctttatctacttcaaaacgactcaccgaccgcatttgagcataggggagcaagagatcatttaccataataagtctggagaacttcttgaaacctctatcggaaatttggttctaaaaatcgatgggaaactctacacaccgcctatccgacttggaatcttgtcaggaatttatcgtcaacatttgctggaaacaggacaggtagaagagaaaatcttaaccttggcagatttagtccaagcagaagctatttacggttgtaatgcagtgagaggcttgtatgcgttaagccttgaggagaactagatgaaactgatatttttacacgggttagggcagtcagcagagagttggaaagaagttcggaatctactgacagattatccttctgaggctattgagttatttccttctggagttagcaactatcaacaagctaaagagcgagtttatcagcatctagctcaagagacagaaccttttattttggttggattatccttaggtgctgctctggcactagaactttccagttacgatttaccaaatttccgagctttggttctatcaggatgcccacttaaattgtccggtaatatccttttttacattcagttgctgatttttaaactacttcccaaaagggtatttgaaaaacagggagcagacaaagctcttatggtcggagtttctgaggaattgaagacacttgatttaacggatatatcaagaacttgtccttatccaaccttactaatttgtggcagcaaagataaaccgaatcttagttctatgagaagtcttcataaactaatatcagaatctcaatttcagattataccagatggacctcatgtcttgaataaggctaaaccaaaggagtttgtagaaaagatcagaagtttccttgaattgctgaaataagtttgataaaataatagtgaaatcgataacatcatcataggagaaagaaatgaataaacgtttatttttaaaaatgagtctggctaccttgccagttttagccttgttttcacaacctgtgttagcagaagaaaacattcatttttctagttgtaaagaagcttgggcgaatggatacgcagatattcacgagggagaacctggttattctgccaagttagaccgcgatcatgatggtgtggcttgcgaattgaaaaatgctcctaagggtgcttttaaagcaaaacaagcggctacaactcaaactgatacaacttcatccacagcaagtggttgggttaagcaggacggttcttggtactattttgatggaaatggaaatccagtgaaaaatgcatggcagggaagctattacctgaaagctgatggtaaaatggcacagagtgaatggatttatgactcttcttatcaagcttggtattatttgaaatcagatggttcttatgctcgcaatgcatggcaaggaaactactatttgaaatcagatggtaaaatggctaaaaatgagcgagttgatggaggccgctactatgtagatgcttcaggtctatggaaaccataagtaaggataaaatctagaaagttaatgcaaacctttgcataaatgagtgaattttgttatactagtactgtaagcattttcaattaattcataattaaaaaggagaatatgatgagtcaaaagattattgggattgaccttggtggaacttctatcaaatttgcaattttaactcaagagggagaaatccaagaaaaatggtctatcaagacaaatattttggatgaaggaagccacattgtagatgatatgattgagtctattcagcatcgtttggacttgcttggattggcagcagtggacttccaaggaattgggatgggatcaccaggtgtggttgaccgtgaaaaagggactgttatcggtgcctacaacctcaactggaaaactcttcaaccaattaaagaaaaaattgaaaaagccttgggcattccattcttcatcgataatgatgccaacgtggcagctcttggtgagcgctggatgggtgctggtgataaccaaccagatgttgtctttatgacactcggaactggtgttggtggcggtatcgttgcagaaggtaaattgcttcacggtgttgctggtgcagcaggtgagcttggccacatcactgttgactttgaccaaccaatcgcatgtacctgcggtaagaaaggttgccttgagacagttgcttcagcaacaggaattgtcaacttgactcgtcgttatgccgatgaatacgaaggcgatgcagccttgaaacgtttgattgataacggagaagaagtaactgctaagactgtctttgatttggcaaaagaaggagacgaccttgctttgatcgtttaccgtaacttctcacgttacttgggaatcgcttgtgctaacattggctcaatcctaaacccatcaacaatcgtcatcggtggtggtgtgtcagctgcaggagaattccttctacaaggtgttcaaaaagtctacgatgaaaataccttcccacaagtacgcacatcaacaaaattggctcttgcaactctaggaaatgacgctggagttatcggggcagcatcacttgtattgcagtaaaataataaaaggagaaaaacactactttaaatcgagtgattttcctcctttctttttttatgctatactagttaggacaataaatgaggtgagagtaaatgacaaaagcagatacgatttttaaagagaatattgaacgaatcctcaaagacggtgtcttttctgagcaggcccgtcctaagtataaggatggaaccgttgccaactccaagtatatgactggtgcctttgccgagtatgacttgtccaagggagaatttcccatcacaaccttgcgtcctatcgctattaaatccgccatcaaggaagtgctctggatttaccaagaccagtctaatagcctagaagttctcaatgacaagtacaatgttcactactggaatgactgggaagtgggagatacaggaaccattggtgagcgctatggtgccgttgttaagaaacacgatattatcaataagcttctcaaacagttggaagccaacccttggaaccgccgaaacatcatctccctttgggattaccaagcttttgaggagacagagggcctccttccatgtgcctttcagaccatgtttgatgtccgccgtgtagatggggaaatctatctggatgcgaccttgacccagcgttcgaatgacatgttggtggcccaccacatcaatgctatgcagtacgtggctcttcaaatgatgattgccaagcatttcggctggaaggttgggaagttcttctacttcatcaacaatctccatatctatgacaatcaatttgaacaagctcaggaattgctccgtcgtgagccatcaaactgccaaccacgtttggtcttgaatgtgccagataagaccaatttttttgatattaaagcagaggactttgagttggtggattatgaccctgtcaagccacagttgaagtttgacctagctatttaaaagaatagaaaaaagaagttgagaaaataaatcccaacttcttttgtttcttaacgtgatacgcggcgacgagctgcttttttacggttttcttcgatgaaagctgctttttgctcttctggttcgatcactttctttttaaatgcgtatactgcacctgcgactgcagcgacagttcctgcgacacctgttacaagacctttagcgaatcctttagccatgagtcttcctcctttatcttcttaatcagccagccccctcaagaggtcacatttttctgactgacctttttgtgttataataatagtaacgaaaaaatgggaatttttcaaggaaaaaagatgaaaacaaaaataattgtgattgttggaccgactgcagttggaaaaacagcccttgccatcgaagttgcaaagcgttttaatggcgaagtggttagtggagatagccagcaagtctatcgaggtctggatatagggacggctaaggctagtccagaagagcaggcagctgttcctcatcatttaatcgatgttagagaggtaaccgagtcttactcggcttttgattttgtttcagaagctaagaaggctattgaggatattcaaagccgtggcaagctagctattattgctggtgggactgggctttatatccagagcttgcttgaaggctaccacctaggtggtgagactcctcatgaggagattttagcttatcgagctagtttggagccatattcagatgaggaattagcccatttggtggagcaagcagaccttgagattccccagtttaatcgtcgtcgtgcgatgcgtgccttggaaattgcccattttggtcaggatttggaaaataaagagagtctatatgaaccgctgattatctgcttggacgatgagcgcagtcagctttatgagcgtatcaatcgccgagtagatctaatgtttgaggctgggcttttggatgaggctaagtggctctttgcccattatccagatgtgcaggcagccaagggcattggttacaaggaactctttccttacttccgtggagagcagaccttggaggatgctagtgagagtctcaaacaggcgactcgtcgttttgccaaacgtcagttgacctggttccgtaatcgcatgcaggtcaccttttatcaaatcggagaatctggtgtgcaagaccgtatttttagccagatagaggagtttttagatgattgaaacggagaaaaaagaggagcgggtcctgctcattggtgtggaattgcagggcatggacaattttgacctctccatggaagaattggccagtttagcgaaaacggctggggcagtcgttgtagatagttacagacaaaaacgtgaaaaatatgattccaagaccttcgtcggctctggtaagttggaagagattgcgcttatggtggatgcagaagaaatcaccactgtcatcgtcaacaaccgtctgacgccaaggcaaaatgtcaatctagaggaagttctgggtgttaaggtcattgaccgtatgcagttgattttggatatctttgccatgcgagctcggagccatgaagggaagctccaagtccacctagcccagctcaaatatctcctgcctcgcttggttggtcaggggattatgctcagccgtcaggcagggggaattggttcccgtggacctggtgaaagccagttggagttgaaccgtcgtagtgttcgcaaccaaatcacggatatcgagcgccagctcaaggtggttgagaaaaatcgggcgactgtcagagaaaaacgtttggagtcaagcacctttaagattggtttgattggttacaccaatgctgggaaatcaaccatcatgaacactttgaccagtaagacacagtatgaagcagacgagctctttgcgactttggacgcgacaactaagagtatccatctgggaggcaatctccaagtaactttgacagatacagttggctttatccaagatttgccgacagagttggtgtccagtttcaagtcaaccttggaagaaagcaagcatgtggaccttctggttcatgttatcgataccagcaatccttaccatgaggagcatgaaaaaacagtcctgtccatcatgaaagacctggacatggaagatattcctcgcttgaccctttataataaagcggatttggtggaggattttacgccgacccaaacgccttataccctcatttctgccaagtctgaggatagtcgtgagaacttgcagacactatttttagagaaaatcaaggatatttttgaatcttttaccctgcgcgtgcctttttctaagtcctacaagattcatgatttagaaagtgttgcgattcttgaagaacgtgattatcaggaagacggcgaagtgattacaggctacatttccgagaaaaataaatggaggttagaggaattttatgactgatattaaaaccttggctctaaaatatgggggctatacaagtctggataaggtctatctggatcaacttctagctggtaaaacagagcaagagcagttggcactgatcactcctccgcctagcgtggtcaatgcttattttgcagaactctaccagaaaaaaagtcctgaggctgcgacggattattttgcggaactcagtcaggaactgaatctttacaatactgagccaagtttcaccctagaaaataagccttttattcggcttaatctgtcgggtaaatcctttggtttttgttatgagagtgagggtctgggtcggattttctctgaaaatgaagagaagatttcggatgacttgctttttgaaattgcgcaaattttcccccatcaactggtctttgaagagtctggtaagatttacatgaaggctgttgtagatgaggaagttgttagcatggagagtctcacagctttgactgatttggaaagcttggctgatggtcgtaaacgtctcaaagcctacagtcaagaggatttattgcaagaagctagagcttttactggcaagcgctatttccgatcggaaaaccgcacagccatgttatatattgattaattagaaagtatcgaatggatattcaatttttaggaacgggggcaggtcagccctctaaagcccgcaatgtttccagtctcgccctgaaactcttggacgagattaacgaagtctggctctttgactgtggagaaggtacgcaaaatcgcattctggaaaccacaattcgaccacgtaaggtcagcaaaatctttattacccacctacatggagaccacatctttggcttgccaggtttcctttctagccgtgcctttcaggccaatgaagagcagacagatttggaaatctatggacctcagggaatcaagtcatttgtcttaaccagccttcgtgtgtcaggttctcgtctgccctaccgcattcatttccatgagtttgaccaagattcccttgggaaaatccttgagaccgataaattcactgtgcatgcagaggagttggaccacactattttctgcgttggctatcgtgtcatgcaaaaggacttggaaggaactttagatgctgaaaagctcaaggcagctggagtcccatttggcccactttttgggaaaatcaagaacgggcaggatgttgttttggaagatggaactgaaatcaaggcagcagactatatctcagctccacgtccaggtaagattatcaccattctgggtgacacccgaaaaaccaatgctagtgtgcgtctggctgtcaatgccgatgtccttgtccatgaatcgacttatggcaagggtgatgaaaaaattgctcgtaaccatggccactctactaacatgcaagctgcacaagtagcggtagaagcaggtgccaaacgcctcttgcttaaccatatcagtgcccgtttcctctcaaaagatatcagcaagctcaagaaagatgctgctagcatttttgaaaatgtccatgtggtcaaagacttggaggaagtggaaatctagcagtcacagaaaggataagtatgcctactattctcattactggagctagcggtggcctggcccaagaaatggttaaacttctgccaaatgaccaactcatcttgcttggtagaaataaggaaaaattagcccaactctacggaaatcatccccatgcagaattgatggaaatcgatattaccgatgactcagccttagaatctctggtaactgacctctatctccgttatggcaagattgatgtcttaattaacaatgctggttacgggatttttgaggaatttgaccagatttccgaccaagatattcatcagatgttcgaggtcaatacctttgccctaatgaatctgtctcgtcgccttgcggctcgaatgaaggaaagtcaaaaaggccatatcatcaatattgttagtatggcaggtttgatcgctactggcaagtctagtctctactcagccactaagtttgcggccattggtttttcaaatgctctgcgcctcgaactcatgccctatggagtctatgtgacaacagtcaatccaggaccaatccgaacaggattttttgaccaagcggacccagatgggacttatcttaagtcggttgaccgtttcttgttagaaccagatacagtggctaaaaagattgtcaagattataggaaaaaacaaacgagaactcaacctcccgattttgttgaacctagcccataagttttatactctctttcccaagctagcagataagttggcaggggaaacttttaattataagtaaaaagaaccaatgtgcaggttgttgctagcctacatattggttcttattatttttcaactatcaaactggacttcttctagtagatagtcgataaagcgttcgcccatcttagagaggcttgttttttcatgctggatatagaccagctcaatggggtcatcaatgtccagtgggatagaaacgatattgtctccgttgaggttgctgttcaaaattcctgtcgcaatggtataaccgtccaaaccaatcaagagattaaagagggtggcacggtcactgactacgatagattttttgtggtattcctgcgagagaatctcttctgaaaagtagaaggagttatgagttccttgatcatagctgaggtaagggaagttctccaaatcagatagtttgaccttgtctttctttgccagaggattggtcttgctgacaaagatatgcggttgcgcggtaaagagatggtgagccagcaggtggttgtcatccagcattttcgttaaaacatcacggttgtagctgttaaaaaataggacaccgacctcactacggaagttcttgacgtcgtcgataatctcccaagtacgagtttcacgaaggaagagctcgtatttctccatatcacttttcttgagtagagaaacaaaggcattgactacaaaggcatagtgctgggaggaaacgctaaagagttcgcggtgggcgacaggatttttatagcgttcttccaaaagctgggtctgctcgacaacctgacgggcataagagaggaactccatcccatcacgggtcaaggtgatgcccttggggttgcggataaagatctcaatgcccatttcattttccaaatctctcacagcgttggaaagactcggttgagtgataaagagttgcttagctgcctcattcatggagccagtttcgacgattttgataatatagtgtaattgttgaattctcatgtttttattgtaccacacttgcgtcagaatcgccaaagaagataggaaaatcagggggagtgtgtgagtctctgtaaagtagttaagaagaaatttttaaaccatttagtaaataagattaaaaattttactcgaaaataagaaatttgcacgatttactcattacttatccaatactagagtttatactagttactgtaaagatgatcatctaaaagaaggaagtaaccttatggctaaaaatacaagtcgtccagagattgattctctaagtttcgaggttgaaaaccaagaacttttcgggaaattacaagctagtggtacacagcttttaaaatgacactagcaggccgctgtggattgtgtttcacctgtttctatgagtgtacgacaaataatgttcgctgttagataaaacaaaaggaaaattctagtgttttattacaaaacattgacaacattttgatttggtgttatatttacggggagaaatacaaataaaacaagacaactttgagattgattctttggattatggaaattaatagccaagaattagatggtaaatccgctgctgtgtggcgtacggctgttagattaacagcacaggggcgctgtggttggtgatttacatattcttatgaatgtatttcgccaaacgtgcgctgtggataaaactctctattttttgacaggaggataaaatggaaggaattattggaacactagaattctatgcacctgtactggccttaggagttgttgtcatagggattgtttactttatgaaaaaaagaaacgatcgcaaataatcaacatcgaccgatacctgaaaaaggcatcggtttttttattacttgaatatattgcacaaaatactcatgccaaacattgaaaggaaccgtataatgagagagtaataaagaaacggaggaatgaaatgatgaaacagcttattgtgacaggattaacgaaaacatttggtcaaggggataatatcgttcatgctttatcagatgtgaacttgtccgttgaaaaaggtgaatttctggcaattatgggggccagtggtagtggaaaaacaacactcctcaattgtatttcaacgattgataaaccaacatcaggtgagattcgatttgaagattttgacatcatccatgccaaggaaaatgaactagctgactatcgtgctaaaaacatttcctatattttccaagcctacaacttggtggaaaccttgacggtctatgaaaatatcgttctacctcttcaaattcaggggaaaaatatcaaaaaacatcaggataagattgaggaaattttggataagttggccatccaaaacttaaaagataagtttcctaatcagttatcaggtggtcagcgacaacgtgtggcaactgctagagccttgattgatgattctaaactgattatcgcagatgagccgacaggagccttggactctgccaattctgaaaaactgatggcgcttttgcaggaaatcaataaaagttttggtattaccattttattggttacgcatgcccctgctgcagccaagtactcttcacggatggtgctacttagcgatggaaagattatggatgatttggaacgtaacagcttatctaatgaacagtatttgcaagagatttacagccgtaccagataggagggggagagtatgtatccaaaattgattttacgaaatgtatttcgaaatttacagacctataccatctattttttcagtctgaccttgatttatagcttgctctacgcttttaatgctttaccaagccatccagtgatgcaaagtttatcaggagcaaaggaaatgttgacgacggtgatgagtcagtacatgggcttgctttcctatctgattctatcggcgattgcctttctcgtcgtttattccacaaactttgtcctgggacggcgtaagaaagagctgggactttatgcaacgctgggaatgaagaagaagcagattatcggtaccctgttctttgaaaccatgctggtcaatatcttttccttgattctaggtttcttgcttggattgattttactggtcattctagctaagattgcatctgagtttttcatggccaattactttggtagtctgcttttctttgatagcaagtctgtcatcttactagtttattcctatttggtaaccagttttattgtaggtgtcatggacattcttgcctttagaaagcaaaatatcattgcacttattcaagaaaatggggtcaaaaaatctgtcttggcaaaaggcaagccagttctccaagtacttctctttattctttcgacagctgttatcggctttggtgctctctatttttcagactatcatcatctatcattcttgaaaagctggggtatcttgctggtatctatcttcgtgatttttgtgattttattttacaataccttgagccattttatcttggtctcccttagaaaactgcctcaaacctactataacaaactaaacacttttaaaatccgtcaattttcaaaacaagctgatagtaattcggtcacgttggctgtcttatccttgaccttgacactggctctcagcttactcgtttttagtggtagtgcctatacgactatgaaccgagagctgaacaaatactcaccttatgatgtaactgtcaatctctaccgtggtaaagagtttcaattttctcaggaatctgtcaaagacagattgaaagccgatggctttgactttaacctcatcaaagaggagtacagctgccctatctattctagtgatttaacttataaagatttgattgataccagcaatctctgggagcatgataagaaacttcctgaatcaaaagtaccgattttaggaatttctgcctacaatcatctccgcaaactgcaagggaaaaaagcgattgacttggcagaagaccaatttctagtcaatgccaattataaaggaactgccaagcagatccaggactttctatcaacgaccaaaaccttcatgattaacggtcattctctcaaccttgcctcttcaaagccacttgaaacagtttactttttatcttcagtaactacaaatgactcaggaaccttgattgtaccagataaggtagtagttggattgacggaagaccacacgacctatgttgccaatttcaaggaaaatatagacaaacgggaagtagaaacattcttgagtcagtggattgaaaaatactacttcactcgtgatggagcagagttgaattcgttcacctatcaaaccaaaggaagtattttcgaggtttaccttggatttatgggcgtcattgtctttgtcatgatttttgtcagtgttatttttatcattatttccctcagtatcttgtcccttcaaacttcaacaagtgctttggatagtgtaaatgattatcaaatcttataccttcttggaaataagaggaagcaaaatcgtactattcttttgcaacagattctaagttatttcttggttccgctggtcatcgcaggtccgctagcatttgccttgagtaccgctcttttgggctattttgagaacttcgctaataccagcatttctattgatatcacctatctgggagtagcggttttactctttgtcctttacttgctagtgacttacagagtaagttggcaaattattgaaaattaagtcaaataccagagttgccaatccgacaattctggtattgtgttataatgatattaaagtagttcaggaagtggatacatatgaaacagtttgtcaaatcgctctcgaaaaactcacttttattgtggtggttgacgatttttaatcatctagctttaatgatttatatttattataggattcctctggacttttcgacagatttttccttgcagatggttttattgctgattattgctttaattgtatttagctatatttgtaatattgtgacctttcggtatagtgagttgaaactttggttgctcctgatgatgtttctcattagctggcaatccatatttaatcaaggagttgcgagcaccctgttgcacttttttgatattcttcatcctctcaactcttttttattggtgtatagttctctgtctattatctttctgggagagaaaataggagaagaactgttgagtgtgtcctttgtgttgacactaatcaccattagttcgtatctgttaagtccttcaatttttttatttctgtccttgtttgcgtctttctttttaaaccttgttcccttgattttactgattttatatcataaagagttgaaaagtaaactcaagtatcagagacgaaatttgtggatattagctttgatattgcctctttcttatttctttttgtatatcaatacgaggggctcaggagtgatgaacctagtctggtatctagaaattcttggtatcttagcttttttacacttcaaaacgattgtcagctctcttcaaaaaagggtatcagagttgaaattgtcctatataaaagctttttcacgcttgtttttactgcttatgtttttgttagtaggcattttcatcatctttcgtctagacttaaacacgagctttttggtattgaatatcatgttactattgttcgggatttgttcggaagaattgattcgcctttttcgttctgctgaaatgctagatgctagggattatgtaaaagttctctttttaaagcgtaaccgcatggtgaaaagtctgctggcaaatgaagacacagaacaacagttctcggaatttcttcacaatgaaatcctgcaaaatgtgatggcgataaaaaatttcaataaatatagtatcaatcgggcttttggtgaacagatcaatctggtgacagaggagttggttcagcggattcgtgagcggatggattattatcagccaatggtagaaacagacgagcagttagacatacagtatcaagggctgattaatcggattgtcaagcgctatcacgcagaaaatgaagtcgtcacacagtttcctgtccactttaggcttttatctccttacgataaaattacctatcgtctggttgaggaattggcgaccaatgccgttaagtacgctagtggtggaaggatttctttgaagattgatatgcatgatgacgctctttttatcatttctgaaaatgactgccttcaaacagaaaaatccttaggttatggcttgaaaaatatgtctaataaaattagtgttttaggtggtcaaatgcagatttttgaaaataacaagagatttcgtgtagaaattactctcccgattgataaggagttgtgttatgaaaattttgttaattgatgatcataaattatttagccaaagtatcaagatgattttagagttatcggaaaacattaaaaaggtccagttagtggataatttttcgactatttcggagattgcttttaatgactacgacattattttgattgacatcaacctgacgagtctgtatcaagctgatgggctgaccttggcacaagagattattgacaatggttgttctagtaaggttgtgattttgacgggatacagcaaaaagatgtatgaacaccgagctaaagctatgggggcttatggatttctagataaaagtatggatccagatgagttggtgaaaaaactggaaaagatttatctaggaggtaagatcttttcagatgaagtgatggtagaggtgctaacaccacgagaaatcgagatactagaactggttagaaatggcttgactattgatgatgtctgtgacaaggtctatgtgagtaaacgtacagtttccaatcacctggccaatatcttttcaaaattaggagtggctaacaggcaggaggcgattcatatcgctgagcagttgggctattttccaccagattaaaaagttgcagaagatgcagcttttttaatttctgcgatacttcttgtgtggtctcttcttgaaaaaaacacaaaattttgctagaatgagtcttatgaaaacattctatgatgtgcagcaattcctcaaacgatttggtattattgtttacatgggaaaacgcttatatgatattgaactgatgaagttggaactctctcggatttacgatgcagggttgatggacaaattagactatctagaggcagaagcggttctacgcagagagcacaaggtagaattggattatattgagaaaaatggagaaaagaactaatggttacttggattttgtgggcacttatactggcaatgttggcatggatgggctttaactatcttcgtattcgccgtgcggctaaaattgtggacaatgaggaatttgaagccttgattcgtacaggtcaattgattgatttgcgtgatccagcagaattccacagaaaacatatccttggtgcccgcaatattccttcaagtcagttgaagactagtcttgcagccctgcgtaaagacaaacctgtccttctctacgaaaaccaacgtgcgcaacgagttacaaatgcagctctttacttgaaaaaacaaggcttttctgagatttatatcctttcttatggcttggattcttggaaagggaaagtgaagactagctaatcttatttccaaattagtcgaatgataggatgaagctattgttttatagtataattaatttgtataaaatttaaggagttcttagaacatgaaagaaaagaagaaaaatccactttttgtgggcatcttgtcgattattcttggtttgttatttccgttgggaggtattggtttaggtattaccagtttattgtatgctaactcacttcaaaaagaatctggactagactataaaacagaaaaaattatagctattgtagggattgtagtttccgtaattaattgggttttaggattgattctttttatgaattaagtagtgtaaaacaaaaaagctttatttgaaagcttttttgttttatccacttttctctaagtagtttttaatgattttcaattcctcttggttcaagggacggtattgaccttctgctagttctgggtctaatgtaaactcaccgaactgaattcgtttgagtgaggtcaccttgacaccaaccgagagaaacattttcttaacctgatgaaattttccttctgaaatggtgatagaagcttgactgagggaaggacttgcagatagaatctctagtcttgcaggtttacagacagtgccatctaaaaagacaattcccttttgaaaggcttggatatggtcaggtgtcagaagtccattaacctcaacctgataagttttatcgacatgatattggggatggaggagctgaaagcccaaaggaccgttatcagtcaagaggaggagtcctgtcgtatctcggtccagtcggccgacggcatagagcatgtcagactggatgtcaggcggaaggaggtccatgacggttggaagttccctgtctttattggctgtaacgacaccagtaggtttatgaagcataagataggtgtgttcatagccttgaatgattcgaccctgaaaaaggagttcttgtagccctgtatcgatattttgagctagggagcgggctgggcaaccatcgactagaatttcccctttgagtaaggcttgtttcatggcttttcggctgattttttcttgggctaataaattatctaaacgcatactgtgcctatcttatcataagtcgcttgctttgaaaaggcttgacgtgaaaagaaaagcacagtgaaaacatttacacttgcttgagttatgttatttacctgaaattatggtataatcgttcagttagaaaataaattttgaatattatagaggaaatcatgacaaaattaagagaagatatccgtaacattgcgattatcgcccacgttgaccacggtaaaacaacccttgttgacgaattattgaaacaatcagaaacgcttgatgcacgtactgaattggctgagcgtgctatggactcaaacgatatcgaaaaagagcgtggaattaccatccttgctaaaaatacagccgttgcctataacggaactcgtatcaatatcatggacacaccaggacacgcggacttcggtggagaagttgagcgtatcatgaaaatggttgacggtgttgttttggtcgtagatgcctacgaaggaacaatgccacagactcgttttgtattgaaaaaagccttggaacaagaccttgtcccaatcgtggttgttaacaaaatcgacaaaccatcagctcgcccagctgaagtagtggacgaagtcttggagcttttcatcgagcttggtgcagatgatgaccagcttgatttcccagtagtgtatgcttcagcaatcaacggaacttcttcattgtcagatgacccagctgaccaagaagctactatggcaccaatctttgacacgattattgaccatatcccagctccagtagataactcagatgagcctttgcagttccaagtatcacttttggactacaatgacttcgttggtcgtatcggtatcggtcgtgtcttccgtggtactgttaaagttggggaccaagttaccctttctaaacttgatggtacaactaaaaacttccgtgttacaaaactctttggtttctttggtttggaacgtcgtgaaattcaagaagccaaagcaggtgacttgattgccgtttcaggtatggaagatatctttgtcggcgaaactattactccgacagacgcagttgaagctcttccaatcctacacatcgatgagccaactcttcaaatgactttcttggtcaacaactcaccatttgctggtaaagaaggtaaatgggtgacttctcgtaaggtggaagaacgtttgcaggcagaattgcaaacagacgtttcccttcgtgttgacccaactgattcaccagataaatggactgtttcaggacgtggagaattgcacttgtcaatccttatcgaaacaatgcgtcgtgagggatatgaacttcaagtatctcgtccagaagttatcgtaaaagaaatcgatggtgttaaatgtgaaccatttgaacgtgttcaaatcgacactccagaagaataccaaggatctgttatccaaagcctttctgaacgtaagggtgaaatgttggatatgatttcaactggtaatggtcaaactcgtttggtcttccttgttccagcgcgtggtttaatcggatactcaactgagttcttgtcaatgactcgtggttacggtatcatgaaccatacctttgaccaatacttgccattgattccaggggaaattggtggtcgtcaccgtggtgcccttgtttctatcgatgctggtaaggctacaacttactcaatcatgtctatcgaagaacgtggtacgatctttgtcaacccaggtactgaggtttatgaaggaatgatcatcggtgaaaattctcgtgaaaacgacttgacagttaacatcactaaggcgaaacaaatgactaacgttcgttcagctactaaggaccaaacagctgttatcaagacacctcgtatcttgacacttgaagagtctcttgagttcttgaacgacgacgagtacatggaagtaacgcctgagtctatccgtttgcgtaaacaaatccttaacaaggcagagcgtgagaaagctaacaagaagaaaaaatcagctgaataagagctagaaagagataaagatggtttatttaatcataggactcctcttattactactctatgtatttgcgacaccagaaagcattaaagggacagtcaatatcgtccttgtcgtctttgctttcgtagcactcttgattttgctgatgttgtctgtcctgcaaatttttcagctaccgacagaattctttatcgcaatcgccatgctcttcctagcatactttagcttgcgagatattaccctcatgtcggttagtaaaaacaaaagaagataaaaagagagctttggctctctttttgtttgttagaatgctgaatctgagcattttcgtttagaattatttccataaaaatggtaaaatagtaagagtagaaatggagttcgagacatgaaagtaatagatcaatttaaaaataagaaagtccttgttttaggtttggccaagtcaggtgaatctgcagctcgtttgttggacaagctaggtgccattgtgacagtaaatgacgggaaacctttcgaggacaatccagctgcccaaagtttgctggaagaagggatcaaggtcattacaggtggccatccattggaacttttggatgaagagtttgccctcatggtgaaaaatccaggtatcccctacagcaatcccatgattgaaaaaggctttggccaagggaattccagtcttgactgaggtggaattagcttatttgatttctgaagcaccgattgttggtattactggttcgaacggtaaaacaaccacaacgactatgattggggaagttttgactgctgctggccaacatggtcttttatcaggaaatatcggctatcctgctagtcaggttgcacaaactgcgtcagacaaggacacgcttgtcatggaactttcttctttccaactgatgggtgttcaagaattccatcctgagattgcggttattaccaacctcatgccaactcatatcgattatcatggttcttttgaggaatatgtagcagccaagtggaatatccagaacaagatgacagcggctgatttccttgtcttgaactttaatcaagacttggcaaaagaattggcaagaaaaacacaagctaccgttgtaccattctcaacacaggaaaaggttgatggagcttatctggaagatggtcaactctacttccgtggggaagtggtcatggcagcgaatgaaatcggagttccaggtagccacaatgtggaaaatgcccttgcgacgattgctgtagccaagcttcgtggtgtggataaccaaaccatcaaagaaactctttcagcctttggaggtgtcaaacaccgtctccaatttgtggatgaaatcaagggtgtcaaattctataatgatagcaagtcaaccaatatcttggctactcaaaaagccttgtcaggatttgacaacagcaaggtcattttgattgcaggtggtttggaccgtggcaatgagtttgacgaattggtgccagatattactggactcaagaagatggtcatccttggtcagtctgcagaacgtgttaaacgggcagcagacaaggctggtgtggcatatgtggatgcgactgatattgcagatgcgacccgcaaggcctacgagcttgcgactcaaggagatgtggttcttctcagtcctgccaatgccagctgggatatgtatgctaactttgaagtacgtggcgacctctttatcgacacagtagcggagttaaaggaataatatgaaaaaaattgtctttacaggtggggggacggttggacacgtgacccttaaccttttgttaatgcctaagttcatcgaagatggttgggaagtccactatatcggggacaagcgtggtatcgaacaccaagaaatcctcaagtcaggtttggatgttaccttccattctattgcgactggaaaattgcgtcgctatttctcttggcaaaatatgctggacgtctttaaagttggctggggaattgtccaatctctttttatcatgttgcgacttcgtccacaggcccttttttcaaaggggggctttgtctctgtgccgcctgttatcgctgcgcgtgtgtcaggagtgcctgtctttattcacgaatctgacctatctatgggcttggctaataaaattgcctataaatttgcgactaagatgtattcaacctttgagcaagcttcaagtttgtctaaggtcgagcatgtgggggcagtgacaaaggtttcagaccaaaaaaattcagaaccagatgaattggtggatatccaaacccactttaatcctaaattgccaactgtattgtttgtcggtggttctgcaggcgctcgtgtctttaaccaattggtgacagactataagaaagaactgacagagcgctacaatattatcaatctaactggagattctagcctgaatgagttgagccaaaatctctttcgtgttgactatgtgaccaatctctatcaacccttgatggaattggctgatattgttgtgacacgtggtggtgccaatacgatttttgagctcttggccatggcaaaattgcatgttattgtgccacttggtcgtgaagctagtcgtggtgaccagattgaaaatgcagcttactttgtaaaaaaaggctatgcagaagagcttcaagaaagcgatttgaccttggacagtttggaagagaagctttctcacttactaagccacaaggaagactatcaagccaagatgaaggcttctaaggaattgaaatctctagcagatttttatcaattgttaaaaaaagatttatcataaggaaagtaaatgtcaaaagataagaaaaatgagggcaaagaaatcctcgaagaatttaaagagttatcagaatggcagaaacgaaaccaagaatatctaaaaaagaaggctgaggaagaagtagccctagctgaggagaaggaaaaggaaagacaagctcgaatggcttcaaaatctgaaaagtcagatgcaactgaggaccaagagagtgaatctgatccaaaagactcaaaatcagctaaggaagagtctgaagaaaaagtagaagagtcagaagacgtcaaaaaagaagtacccaaagaagaaccaaaatccaaagagccaaagaaacagaataaacaggataaaaaactagagaaaaagcctgtaaaggaaaaaccggtcaaaccgaaaattccaggagttcatatctggcgggctatctcgattttgtttctcagtctgattttattggttgtctctgcttatttgcttagtccttatgcgaccatgaaggatattcgtgttgagggaacagtgcaaactacagatgatgatattctacaggcttcaggcattcaggattcggattatacgattaaccttctgctagataaggcaaaatatgaagagcagattaagtctaattattgggttgaatcagctcagcttgtctatcaatttccaaccaagtttacaatcaaggtcaaggaatatgatattgtggcctactatgtttctggagaaaatcattatccaattctttcaagtggtcagcttgaaaccagttcggtcagtttggtgagtctgccagaaacttatatatcagttctctttaatgacagcgaacaaatcaagacctttacctcagaacttgctcaaattagcccagaactcaaagcagccatcgaaaaggtggaactagccccaagcaaggtgacatcagatttaattcgattgactatgaatgattcggacgaagtcttggttcccctttctgaaatgagtaagaaattgccttattacagtaaaattaagcctcaattgtcagaaccaagtgtgattgacatggaagctggaatttacagctacacagtggcggataaattaattatggaggctgaggaaaaagccaaacaagaggctaaggaagctgagaagaaacaaaaagaggaagagaagaaaagactggaagaacagcagaataaattagaagaggaaaggaaaaagctggaggaagagggcaatcaaaaccaaacgacccgacgttcatcgcgccgctaggtttagcttttctcttgtagttcttcagtggtcatgtttttacttgacaagttctagtagaaataatagaatagtaaaaaacctttaaagcagtccagagaggcagctaaggttagacggtgaaagggtggagactacccatttttcgtggaaccttgctgttggcaggttccttttttcgtggcttcttgtggccagactctctcactagcaaaggtaaaaggagaaacctatgcgagaacatcgtccagttattgctcttgattttcctagttttgaggcggtcaaggaatttttagctctttttccagcagaagaaagcctttatcttaaggtagggatggagctttattacgcaacggggcctgagattgtctcttacttgaaagaccaggggcacagtgtctttttggatctcaagctgcatgacattcccaatacagttaagtcagctatgaaggtcttatctcagcttggagtggatatgaccaatgttcatgctgctgggggtgtagagatgatgaaggctgcgcgtgaaggtcttggaagtcaagcaaaattgatagctgtaacgcagcttacatcaacgtcagaaactcagatgcaggactttcaaaacatccaaaccagcctgcaagagtctgtaatacattatgccaagaagacagctgaagctggcttggatggtgtcgtttgctcggctcaggaagtgcaactcatcaagcaggccaccaatccagattttatctgtctgacaccgggcattcgtcctcagggagcagcgattggagaccaaaaacgcgtcatgacgccagcggatgcttatcaaatcggtagtgactatatcgtagtgggacgtcccattacccaagctgagaatcctgttgcagcttatcatgccatcaaggatgaatggacacaggactggaattaaagaactagattagaaaaataaaaggagaagaccatgacacttgctaaagatatcgctagccacctcttgaaaattcaagccgtttacctcaaaccagaggagcctttcacttgggcatctggtatcaagtcaccgatttacactgataatcgtgtgacactagcctatcctgaaacgcgtactctaattgaaaatggttttgtagatgctatcaaagaagcctttccagaggtagaagtgattgcaggaactgcgacagcagggattcctcacggagccatcattgctgacaagatgaatctgccatttgcctacatccgtagcaaaccaaaagaccacggagctggtaaccaaatcgaaggccgcgtagctcaggggcaaaagatggtagtggttgaagatcttatttcaacaggtggttctgttcttgaagcagtagcagcagcaaaacgagaaggagcagatgtgcttggagttgtagcgattttcagctaccaattgccaaaagcagataagaacttctcagatgcaggtgttaaacttgtgacgctttctaactacagtgaattgattcatctagcccaagaagaaggctatatcacaccagaaggcttggatctcctaaaacgctttaaagaagaccaagaaaattggcaagatgcttaagacatagaaaatcaggtagtcactaggattacctgattttgtttttaatactaaagttgagcgataacttcctcagttgtcaaaacttggttggcaatgtagccgtagtttgttagtgcagcttggtaggcttcttcacctggagcaccgacagcatcgttaacaacaatgacattgtagcctaattctatgagttcacgcatgtgtgaatccacgcagagattagcattcataccagccaagatgacggtgtcgataccatttttgcggagttgaaggttaaggtcgttgctttctgggccaaagattttatgtccgttgacaacaatagtatcttcatccaaaaatggtttaatctcttcaatcatatctgctccagagccttctggaattgctgaatactggctatcacgccaaaacatttcgttttcaatcatcatcgtttcaccagcagctttaaattgccacttgtgatcgtgtggatagaagtagtgcggtgagataaaacgcttgtagccacgctctttagcaagagcgaaaagctttgtcagattttcaatagtattaactttttcaagaacatctttagttgctccgaatcctttaccagtagattttaagaattcaacttgcgggtctgtgataacaaatgcgacatttttctgattgaacatgaggttcctcctaatatgatttgattaacagccaataggaatttagactgttagtttgatgattttccaaatggtagttttagttacatactgaccgttcggtacaattataataacatctagaattgaatttgtaaatcaatttgctcagaacaaaaattttaatgataaaacagtggcaaaaggaggtggtttcaattgtttggtctcagactctgaatctgctataataggaaaaaagagaggtgagcagatgagcgttaaagagcgtattttacaaagtgctgaggaattgatttatcagaagggttatgatgccacctccatcagtgacatcatggaggtggctgatgttggcaaggggcagctttattattatttcaaatctaagaaggaaattggtttgacggtcattcaagatattttagcaaagtggcgaaaagagctttttgaagatatttttgaagcagacaagtctgacagtgacaagttttcggatatgattgactgggtttgtcaatttcatgaaagtcagacagtcttttatggttgcccaattggtaatctgattgtggaattgtccacagaagatgagaacttccgctgtcctctcaatgattttatgacccagtggacagagaagttagccagcctcttgcaagacctgcatgctgactggtcagaagaacggtcgcagttgcaggcccgtcaagtcatctccagtattcaaggcagcattgtcattctcaaagtcagccaagacatccaagttttagaaaataatatgacggatttgaaaaagaattattgttaatttttagccgaagaattaaaagtatgttaatttatggattgtggttaagaggtaagaatgacaacagatattaaaactgaaattggtcatagagtaagacaggaacgtgaacgtcacaaattgacgagagaagagatctgtggacagaagctgacttaataatcaaacagctgatgcgtactgagcttgggcaatccttgccaacaattactaagttacaatatttatctaagcgattagaagttccgatagatacttttcttgaaaataaagaactagctcttcctgaggaatactttaagataaagtaccgtatcatgaagtctccagtatagtatatggagattccaagcgtattacggaaaaactaactttaattgaggaagtttataattgttacggtgacatccttcctgaagaagagttgctgagtctagacttgattgaaagaatattaggcttgataagaacagggacaggtagtttcgctgaagatatttttgatgattattttaagcaagtaacactaaagcaagtttacacattcaatgatttactattaattgattattttgctatgcaatgtcaagacttgatttatagaagagagcattagatgattttcggattaagttgttgaaacagcaattagttagtgatgaaatgtataatgtagagctactatcagttctttgtgccatagcggttgtttatgttgttcataatgactataaacatatgatatctctagtaaaaagatgaatgaaattttatcagtaacaacgttgcaagtctataaacctggaatttcagtatttgaagctaagtgctatctttattttgaaaatgataaaaataaagcaaaggaactttatcactcagcaactatactagctgaacaatttgatgataaagtattagaaaatgaaaagattatttgaatttccataacttaagaaagttcatcatttttaattatctctgtaaaatgattgaaagtatgaaatttccaaacaaaatatttgaaaagttttgaaaaaagagttaagatatttttgtaacatacaaagtaaacgcttacttattaaggagggcattttatgtcatacaaaacaagcaatgcagaaggtcatgtagatttcattaatacctatgatttggagccaatggcgcaacaagttattcctaaagcagcatttggctatatcgctagtggggcggaagatactttcactttgcgtgagaatattcgtgcctttaaccacaaactcatcgttcctcatacactttgcaatgtagaaaatccaagtacagagattgaatttgcaggtgaaaaattgtcttcaccaatcattatggcgcctgttgcagctcataaattggcaaatgaacaaggtgaagtggcgactgcgcgtggtgtgcatgagtttggttctctttacacaactagctcttactctactgtagatcttccagaaattacggaagcccttcaagggacacctcattggttccaattttactttagtaaagatgatggaatcaaccgccacatcatggaccgtgtgaaggctgaaggttataaagcgattgtcttgacggcagatgcgactgtagggggcaatcgtgaggtggacaaacgtaatggttttgtcttcccagttggcatgccgattgttgaagaatacctgccagaaggtgctggtaaatcaatggactttgtttacaaatcagctaaacaacgcttgtctccacgtgatgtagaatttatcgctgaatactcaggacttcctgtttatgtcaagggaccacaatgccgtgaggacgttgaacgttcgcttgctgcaggtgcttctggtatctgggtgaccaaccatggtggccgtcaaatcgacggtggaccagctgccttcgattcacttcaagaagtagctgaagcagttgataaacgtgtgccaattgtctttgactctggtattcgtcgtggccaacacgtctttaaagccttggcttcaggagcagacttggtagctattggccgcccggttatctatggcttggctctcggcggtagtgttggtgtgcgtcaagtctttgaacacttgaatgcagaattgaagacagttatgcagttatctggaactcagactattgaagatgtcaaacacttcaaactccgtcacaacccatacaatccaaccttcccagttgaccctcgtgacttaaaattgtattgataaaatagcttgcctccacttgatgtggaggtttttcttcgtctataggaagaataaatcaccattgaaatctatataaatatatttttcagtcaaatatcttgctagggctttcattttttgctatactggtccagtaattaaataataaagacatttggggtgctttaggctgagatgatacccattgaacctgatacagttaagactggcgaagggaaatgtgaaacgttttttcgtatggcgaaatgaacaatctaatcttgtaagctaaactctaattcttgattgtaattggagtttttttgtttatataagctgaatgaaggtgatacaaagcatttaggtagctcttcttgaacgcccttgattttctttaaaaaggtcaagtaaaactaggattttcttgatgttttgttgattacgaacgagtaaagagaggaaaagtaaatatggaaacacaagactatgcatttcagccaggtttgactgttggagaattattaaaaagtagtcagaaggattggcaggctgcaatcaatcatcgttttgttaaggaactttttgcggggacaattgagaataaggtcttaaaagaatacctaattcaagattatcacttctttgatgccttcttatccatgctgggtgcctgcgtagcccacgcagaccagcttgaatccaagcttcgttttgccaagcaactaggctttcttgaagcagatgaagacggttatttccagaaggctttcaaagagttaaaagtatctgagaatgattatctggaagtgaccttgcatcctgtaacaaaagcctttcaggatctaatgtattcggcagtggattcatcaaactatgcacatcttttggtcatgctggtcattgcagaaggtctctatttagactggggttctaaagatttggctctacctgaagcctacattcattcggaatggatcaatctccacagaggtcctttctttgcagagtgggttcaatttctggttgatgaacttaatcgtgttgggaaaggtctagaagatttgacagaacttcagcaacgctggaatcaagcagtcgttttagaattagccttttttgatattggttacgatgcctagagaaagtttaggatatttacaaatttgatgaggtaattctcttcgaaaatcaaattcaaaccacgtcagcttcaccttgccgtactcaagtacagcctacggctagcttcctagtttgctctttgattttcattgagcataaatcattcaatgtaaataaaaaaaatttcttaacgaaagatagagataaatcgaaatcagtagatcgtataaagtgaaaaggaaagatttcaatatgacaagtttaaaattattaaaagaaaaagcacctttggtcatttgtatcaccaatgatgtagtaaaaaatttcacagcaaatggattagtagcactgggtgcatcaccagccatgagtgagtttccagcagatttagaggatttgttaaagtatgctggtggtttattaataaacataggaacattaacagatgaaaattggaaattataccaagctgctctgaaaattgcagagaaatataatgtcccagcagttttagatcctgtagcctgtggagcaggagaatatagaaaaaaagtagcagatgatctaattaacaattacaaactagcagcgattagaggaaatgctggcgagattgcctctttagtaggaataaatgtggaatctaaaggagtagatagtgcgggtgtagataatattgacgaaattgctctagcagcaaatgagaagtttaatattccaattgtagtaacaggtgaagtggatgctattgcggtaaatggagaagtggtaacgattcataatggtagtgccatgatgccaaaagttattgggacaggatgcttattaggtgctgtagtagcaagctttatcggactagaaaaaggtcaagaattgaaatcattagaaacagcaatgttggtttacaatatcgctggagaaatggcagaaaaacgtccaaatgggcatcttcctggaacatttaaagttgaatttataaatgccttatacgagattacagacgaagatgtaaagaaattcaaaagagtgaagaaaaatgtttcataaagaattactaaaactatattttatttgtggaacgactacttgccaaggaaaagatctatatacggtcgttgaggaagccttaaaaggtggtataaccttatttcaattccgtgaaaaaggtgagggagccctgaaaggtatagaaaaagtcgaactagcaataaaactacaggctctttgtaaaaaatataatgttccatttatcgttaatgatgatattgatttggcattggaaatagatgctgatggcgtacatgtaggacaagatgaccttggagttgatgaaattagaaaattgatgccagataaaataattggtctttctataaaaaacgaggaagaatttcaacaatcaaaagttgaatatgtagattatgttggtgttggtcctgtatttgatacccagtcaaaggatgatgctggtggtgctataggttatgaaggtcttaaattgatgagaaaactattgccacaaatgcccttagttgcaattggtgggatacagacgcaacatattaaagacattatgaagaccaatgttgacggtgtttcaatcatttcagcaatatcgtatgcaaaaaatatagaaaaaactgttcgagaaatgagtgaaaaataggtatcgatctaaccaaagaaagatctgctgtatttccagttcaatttcttgaactggaaaaaatcgtttgttataatatttatataattaaataataaagacatttggggtgctttaggctgagatgatacccattgaacctgatacagttaagactggcgaagggaaatgtgaaatggttttgtatttatagaaactaaccatctaatcttgtaagctgaactctaattcctatctgtaattagagttttttcttttacgaaactggatgaagatgatacaaagcatttaggtagctcacattgaataccccacttttctttaaaaaaggagtttttttatgttgaaaaaatggcagttaaaagatgttatcttacttgctttcttgtctatcttttttggtggtgtttttgtgggttcaggctatctgtttgatatcctcaccctgattttagcacctcttggtttacaggcctttgccaatgaaatcctctttggtctctggtgtatggctgcgcctattgctgcaatctttgttccaagagtcggaagtgcaacgattggagaagtgctagctgcgcttgctgaagtcctttatggtagccaattcggtctaggtgcccttttgtctggcttggttcaaggtttgggaagtgaacttggttttatcgtaaccaagaatcgctatgaaagttggctctctctaactgccaatagtattgggattacgcttgttagctttgtctatgaatacattaagttaggttactatgccttctcccttccttttgtcctttccttgcttgtagtacgttttatttccgtctttttcttctgtaccatcttggttcgtgccattgtcaaactctatcatcagtttgcagctggaggcaaggcatagatggggctggaactacgagcgattcagtcaccaatcttccctgagccgcttgattttacttttcatgcgcaagcctttaccttgttagttgggagcagtggttcaggaaaatccagcctctttcaaatgattgcccaagtcagttctcttccctatagcggtcaagtcctgataaatgggagcgaggtcagtcagctttctatcatcgaacgtgtccagacggttggtattctctttcaaaatcccaatcatcaatttaccatggagaacttgtttgaggagctgatttttaccttggaaaatattgggcatcccgttcaggaaattgattctaaaatagcagatgtggttcgacaatgtcgctgcgagaagatcttgcaccgtcccatccatcacttatcaggtggggaaaagcaaaaggctgctttggctgttctctttgctatgaatcctagggtctatctcttggatgagcccttcgcttccattgaccgcaagagtaggatagagatattggagattctaaaagagttggcctctaatgggaagacagttattttgtgcgaccatgatttatctgactatgaagcctatatcgaccatatggtggagctaagagacggacaactaacgaaaataaatcaaatccctgcctctgaaatgacacaggctgtttcaaaggagattgcttctagcccagaactattccatatggatcgaacaacttgtgagctggataagcatcccctcttttcaattgcggatttcacattttaccaagggatttcctgtatcttgggtgataatggtgtcgggaaatcaaccctctttcgatctattcttcaatttcaaaagtataaggggcgcattacctggaaggggacagtcctgaaaaagaaaaagagtttgtatcgtgacctgacgggtgttgttcaggaagctgagaagcagtttatcagagtcagtctgcgagaggaactgcaattagatagtccagactctgaaagaaatcagcggattctccaagctttacaatattttgatctggagcaggcatttgataagagtccctatcaattaagtggtggccagcaaaagattcttcagctcttgaccatcttgaccagcaaggcgtctgtgattttgctagatgaaccttttgcaggtttggatgatagagcctgccattatttttgcaagtggattgtggaggagagaaatcagggaagaagttttctgatcattagccatcgtttagatcccttgatctctgtggttgattattggattgagatgactagtcagggtctcagtcatgtgaaaaaagtgacaattaccaaaccactcacatctcagagtagcaatactcaaggggaggtgagatagtatggtcaaagtagcaacccagacaccgattatcagtctcttcttgctgattttatccttggaaacatctttcattccttcgattgctcttaatctctcggtagtcgcattttgcattctctttatgctctattaccggcgatttaaagtattggcttggatgattctgctcgccattttgccatccttggccaactactgggcagttcagttacatggggatgcttcgcaggcagtcatgcttggaacgagggcctttgtgaccgtttgtattggtcttgtctttgtttcctctatttccctaaaagagcttctcttgtacttggctcaaaaggggttatcacgctcttgggcctatgccttgattgtggtattcaattccttcccccttatccagcaagaaatcaagtccctcaaggaagcttgcttattacgcggtcaagaactacatttttggtcgcccttgatttacagcaaggttctgatgacagtctttaggtggcgccatctttacctgagagccctatcggcgcatggatatgacgaacatgcacaggcggagaatcgctatcggactttttatattcctcaaaggacactattcatctacctgcttttctttttattgcttcaaaccagtctatttttataaaggagttattatggaatttacagatattgcgatggaattatccaaggaagcttggcagacttcctttcatcacccctttgttttacagttgcaagagggaaatttagacctgtccatctttcgctattacttgattcaggatgcctactatttgaaggccttctcagaagcctatcacctcttggctgataagacttcaaatcaagagatgaaaagactcttgaaacaaaatgctcagagtctagtggaaggtgagttatttatccgccaacaatttttcaaggaattggaaatcagcgatcaggaaatggatgagcatccaatcgctccaacctgctatcattatatctctcacatttatcggcaatttgcagagccaaacttgggtattgcctttgcaagcttgctgccttgtccttggctatatcatgatataggcaaatcacttaatcttaaaccatcaccaaatcctctctatcaacaatggattgaaacgtatattacggatgaattggagcagcagatcagagaggaagaggctctggtcaatcaactctatcgagaaagtgacgagacagacaagaaaaaaatgctagatgccttccacatcagtgttcatatggaagctaagttttgggaaatggcctaccaacaccagacatggaagagcgatttacagtctttagaaacaggagaagaatagaaacatgagaaagcaccaattacaagttcacaaattaaccattttatccatgatgattgcccttgatgtagtccttacgcctatctttcggattgagggaatggcaccgatgtccagtgtagtcaatattctagctggaatcatgatgggacctgtttatgccttggctatggctacagtgacagcctttatccgtatgacgactcaagggattccgcctttagctctcacaggagcgacttttggagcccttctagcaggtctcttttataagtatggtagaaaattttacttttctgctttgggagaaattttgggaacaggtattattggttctattgtttcctatcctgttatggtactctttacaggatcggccgctaagcttagttggtttatctacactcctcgatttttcggtgcaaccttgattggtacagcgatttcctttattgcctttcgatttttaatcaagcaggaattctttaaaaaagttcagggatatttctttgatgaaaggatagactgatgcaggcatttacaaatccttttcctctggcaacgacttccctcattcactgtattaccaatgagatttcttgtgagatgctagcaaatgggattttggctctgggatgtaaaccagttatggcagatgatccccgtgaggttcttgattttactaagcaaagccaggcactcttcatcaatttggggcatttgtcagctgagaaggaaaaagcaatccgtatggcagcttcttatgcagatcaagtttgtcttccaatggtagtagatgcagttggcgtaacagtttcatccattcgtaagagcttagttaaagaccttttagactatagacctacggtacttaaaggaaatatgtcggaaatccgaagtcttgttggcttaaaacaccacggcgttggggtagatgcgagtgctaaagatcaagaaactgaggatttgcttcaagtcttgaaagactggtgtcagatctatccaggtatgtcattcttagtcacaggccctaaggacctcatcgtttcgaagaatcaggtcgctgtactgggaaatggctgtgctgaattagactggataacagggacaggagacttggttggagctttaacagctgtttttctcagccaaggaaagactgcctttgaagcttctttcctagcggtttcttatctcaatatctccgctgagagaatagttgttcaaggaatgggattggaagattttcgttaccaagtactcaatcagctttcactcctcaaaagagatgaaaactggctagatgctatcaaaggagaggtttatgaatagagaagcacttagactatatctggtaaccaatcgctaccaagattccttgcaaagttttcttgaaaagattgagacggcttgccgctcaggggttaccatagtccaattacgagaaaaaaatctcacaacaaatcaatattatcaactggcaaaacaagtcaaggaaataacagatgcctatcaggtacccttgataatcgatgatcgtttggatgtttgtcttgcggttgatgctgctggtctgcatattggagacgatgaactaccagtttcggttgcccgcaaagtcctaggtcctgaaaaaatcctcggtgtcacagctaaaactgtaaaaagagccctcgaggcagaagaaggaggtgcggattacttggggacaggagccattttcccgactacgaccaaggaaaatgcacccatcactctgatttcaaccttgaagacaatttgccaaagggttgccattccagtagttgccattggcggcttgacatcagagaacattgaccaacttatcggcacgggcatagctggtgtagctgtagtgcgtgatttgatgcaggcagaagatatagagacaaaaacgcaagcctttttgacaaagttggatgacattattttctaattaatactcaatgaaaatcaaagagcaaactaggaagctagtcgcaggttgctcaaagcacagctttgaggttgcagataaagctgacgtcgtttgaagagattttcgaagagtataaaaactctctaattcccttaaagtaggaactagagagtttttttaatctttaaagcttgtatggttaactgggccagaaccatgaccgagttgaggggcgtcttggatggctttcgtgataaaggccttggctttatcgactgcttgatagagggttttccccttggctagttcagcagtaatcactgcagcaaaggtacatccagtaccatgtgtatgacaggtttgaattcgtggactttcccagacaaattggtcctccttggtaaagaggaaatccttggcaccgccttcgagatggcctcctttgatgacaacagactgaggaccaaattcttttaaaatcaggcgaccggcacgctgcatgtcttcaggatcatggattgaaaaaccaacaatctcttctgcctcaggaagattgggtgtaataatagttgcaaggggaagtagatttgtttttaggtagtctctggcactggtatcaatcagggtgtctccgcttgttgcgaccataacagggtcaaggacgtagggacaatccagctttttaagatagggctggatgatctccatgatctcagtagttgccaacatccctgtttttacagcctgaggtggaatatcagaaaagacactctccaattgggctttcaacatttgaggagaaacgtgctcgattaattgaacacctctggtattttgagcgacaagactggtcacaacggccattccatagacatctctagcttggaacgactttaagtcagccataatgccagcaccaccactagggtcagtccctgcaatggtcaaagcaacgggtaaataagtcatctaaaacctcccaaccaactgaagtttgtattcttaagaacaagctagtctgttttagaaaggcaatagaagactgctagtccccattatcatttccacttccatcagctagcattacctagattgagtcaaagggtctaacagtcgttaatctcagctttacgcacccctagtggttgttttcttttttctttagtatagcatattttcatagtttatatagtaagatttgactgcaaatcctttatcatagggttaaaattcaatttttcaaagaaaagattaatttcatagttgacaaatgtagattttaagagtatactgataattgtaattgacaaatgtagattttggaggtgtgattatgcagatttcagatgcagaatggcaggtcatgaagattatttggatgcaaggagagcagactagttcagatttgattagggttctggcggagcggttcgactggtccaagtcgaccattcaaactcttttggctcgtttggttgagaaagagtgcctgacgaggaaaaaagaaggcaagtcctttgtctattcagcccttttaactttggatcaaagtcgagacttgcttgttcaagatatcaaagataaagtttgttcccgtaggattaagaacttgttggctgatttgattgctgaatgtgattttactcaggctgacttggaagacttggaagctgtgatttctgagaagaaatcaagcgctgtaacagaagtaaaatgtaattgtatgtaaaggagacgtcatgttgaatattattgtaaccattatttgtattgcccttatcgcgtttatcttgttttggtttttcaaaaagcctgaaaaatctggacaaaaggcccagcaaaaaaacggctaccaagagattcgagtggaggtcatggggggctatacgcctgagttgattatcctcaagaaatcagtgccagcccgcattgtctttgaccgcaaagatccttcaccatgtttggatcagatcgtatttccagactttggtgtacatgcggatctgccaatgggggaagagtatgtagtggaaatcacgcctgagcaggctggagagtatggtttctcttgtggcatgaatatgatgcacggtaagatgattgtagaataggagaatgatatgactgaaattgtaaaagcaagtcttgaaaatggtgttcaaaaaatccgtatcacggcagacaaaggctaccatccagcccacattcaactgcaaaaaggagttcctgctgagatcacctttcaccgtttgacaccttcaaactgttataaggaaattctgtttgaagaagaaggcctcttggaaccaatcggcgtggatgaagagaagacaattcgttttacccctcaagaattaggtcaacatgaattttcttgtggtatgaagatgcaaaagggaagttatacagttgttgagaagactcgaaaatctctatcacttttacagcgtttttggattactagtatctttactgtgcctcttgtaatcctcatgattgggatgtcgacaggaggaattagtcaccaagtcatgcgttggggcacctttttagccacaacaccgattatgctagtagcaggtggtccttatatccaaagtgcttgggctagttttaaaaagcacaatgccaacatggataccttggttgctctgggaaccctagtggcctatttctatagcttagttgccctcttcgctggcctccccgtttactttgaaagtgctgcctttatcttcttcttcgttcttatgggagccgtttttgaggagaaaatgcggaaaaatacttcccaagctgtggagaaattacttgacttgcaggctaaaacagcagaagtattgcgtgaggataactatgttcaagtccctttggagcaagtcaaggtaggtgacctgattcgagtgcgtcccggtgaaaagattgcggttgatggtgtcgtagtagaaggtatctctagtattgatgagtctatggtgacaggtgagagtctgcctgtggacaagacagttggagataccgtcattggttcaaccatcaataatagtggaacacttgtttttagagcagaaaaagttggttcagagactgttttggctcagattgtggattttgtgaagaaagctcagacaagtcgtgcgccgattcaggacttgacggataaaatttcagggatttttgttccagcagttgtcattttagggattgtgaccttttgggtttggttcgtcttgctcagggatagtgtagttgtgcttggagcgagctttgtgtcttcgcttctctatggagtagcagttctgattattgcctgcccttgtgcattgggacttgcaacaccgacagcccttatggtggggacaggtcgcagtgccaagatgggagttctcctcaaaaatggaacggttctacaggaaatccagaaagtccaaactattgtttttgataagacaggaactttgacggaagggaaacctgtggtcacagatatcatcggcgacgaagtagaagtgcttggattggcagcttccttggaagaagcttctcaacacccattggctgaggctattgttaagcgagcgactgaaactggacttgagcttcacactgtggaaaatttccaagccttgcacggaaaaggtgtttcagggcaaatcaatggaaaacaagttttgcttggaaatgctaaaatgctggatggcatggatatttctagcacttatcaggaaaaactagaacaactggaaaaagaagctaagacagttgtgttcttggctgttgagaatgaaatcaaaggcttgcttgctctgcaagatattcctaaggaaaatgctaagcttgccatcagtcagttgaaaaaacgaggtcttaaaacagtcatgctgacaggagacaatgctggtgtggcgcgtgccattgccgatcagatcggaatcgaagaggtcattgcaggtgtcttgccagaggaaaaagctcatgaaatccataaactacaagcgtctggcaaagtagcctttgttggggatggtatcaatgacgctcctgcccttagtgtagcagatgtggggattgctatgggagctggaacagatattgccatcgagtcagcagatttggtgttgacaactaataacctcctaggagtggttcgtgcttttgacatgagtaagaaaacctttaatcgaattctgctcaatcttttctgggcctttatctacaatgtcgccggaattccgattgcagcaggagtcttttcaggtgttggactggctctcaacccagaactggcaggtctagccatggcctttagttctgtatccgttctgaccagttcactcttactaaactttagtaaaatagactaaaagcgggcttgctcgctttttatactcttcaaaaatctcttccaaccacgtcagctttgtctgcaacctcaaagctgtgctttgagcaacctgtggcgagcttcctagtttgctctgtgattttcattgagtattataaaacagaagctaaaaacgttttcaaactgtactgtaatagagaataaaaacttctgagcagattcttagtaaagtcaaaataaatgtgataaattagtattgtaaaaatttactgaaacgttttcaaaaactatatgaaaccttttttagtagatttaaaaatatttgaaggagagttatcattatgactcaagggaaaattactgcatctgcagcaatgcttaatgtattgaaaacatggggcgtagacacaatctacggtatcccatcaggaacactcagctcattgatggatgctttggctgaagacaaagatatccgcttcttgcaagttcgtcacgaagaaacaggtgctcttgcagcggttatgcaagctaaattcggcggctcaatcggggttgcagttggttcaggtggtccaggtgcgactcacttgattaacggtgtttacgatgcagctatggataacactccattcctagcaatccttggatcacgtccagttaacgaactcaacatggatgctttccaagaattgaaccaaaacccaatgtacaacggtatcgctgtatacaacaaacgtgtagcttacgctgagcaattgccaaaagtaatcgacgaagcttgccgtgctgcagtttctaaaaaaggtccagctgttgttgaaatcccagtaaacttcggtttccaagaaatcgacgaaaattcatactacggttcaggttcatacgaacgttcattcatcgctcctgctttgaacgaagttgaaatcgacaaagctgttgaaatcttgaacaatgctgaacgtccagttatctatgctggttacggtggtgttaaagctggtgaagtgattactgaattgtcacgtaaaatcaaagcaccaatcatcacaactggtaaaaactttgaagcctttgaatggaactatgaaggtttgacaggttctgcttaccgtgttggttggaagccagccaacgaagtggtctttgaagcagacacagttcttttccttggttcaaacttcccatttgctgaagtttaccaagcattcaagaatactgaaaaattcatccaagtggatatcgacccttacaaacttggtaaacgtcatgccctagacgcttcaatccttggtgatgcaggtcaagcagctaaagctatccttgacaaagtgaacccagttgaatctactccatggtggcgtgcaaacgttaagaacaaccaaaactggcgtgattacatgaacaaaatcgaaggtaaaactgagggtgaattgcaattgtatcaagtttacaatgcaatcaacaaacatgctgatcaagacgctatctactcaatcgacgtaggtgacactactcaaacatctactcgtcaccttcacatgacacctaagaacatgtggcgtacatctccactctttgcgacaatgggtattgcccttcctggtggtatcgctgctaagaaagacaatccagatcgccaagtatggaacatcatgggtgacggtgcattcaacatgtgctacccagacgttatcacaaacgttcaatacgaccttccagttatcaacgttgtcttctcaaatggtaaatatgccttcatcaaggacaaatacgaagacacaaacaaacacttgtttggttgtgacttccctaatgctgactatgcgaaaatcgctgaagctcaaggtgctgtaggatttacagttgaccgtatcgaagacatcgatgcagttgttgcagaagctgttaaactcaacaaagaaggtaaaactgttgtgatcgatgctcgcatcactccacaccgtccacttccagtagaagtacttgaattggatccaaaacttcactcagaagaagcaatcaaagacttcaaggaaaaatacgaagcagaagaactcgtaccattccgcctcttcttggaagaagaaggtttgcaatcacgcgcaattaaataattcctctcgtcgaaaatcaaatttaaactgtgttatcttcaccttgccgtacttcagtactgcctgcggttcgatgccttgtttattctttgattttcttagagcgaaacttaaaaagatcggagcaatccggtctttttatggaggatagtaaatgaatttaaatcaattagatattatcgtttccgatgttccacaagtctgtgctgacttggagcgtattttggataaaaaatccgattatgttgatgacagttttgctcagtttacgattggcagtcactgtctgatgttgtcccaaaatcatttgattcctttggaagattttcagtcaggaatcattcttcatatcgaggttgaggatgtagaccagaattaccaacggttgaaagaacttggtatccaggttttaaacggaccaactgtaaccgattggggaacagagtccttattagttaaagggcctgctggtctagtgattgatttttatcgtatgaagtaggtaattctattatcaaattttttatctaaacattcttggagtgaaacttaaaaagatcggagcaattcgatcttttttgtatttatgcgactttcagtccgtctcgctccgttaggtgcgagacaaaaaaccacccgttttcacgggtggttatgatttctacacttattgtttggcttcctgttttaattgttgcacctgttcctcgtactggacaagctccctgtcttttatattgatagtcgcttctgcttcagcaatgcggcttctcagatcttgagtcttgttatggtgatagctaataccaatagcactaccagcaatgatcccgattactagacaagtaaaaatcaccaaaatcaagggagcagatagttgtgtaaagacaagactgacagttactgtttgacgattgagtagaccaaatgagatcacaatgactaataagctcaaaccgccaattagataagccttatctttcagtgacaattcattaaatttttttagcataagttccttttctcctgactatgttgatagaaaactacacaccatttaggtattaacaaaattcattttactagaaaatttcgatactgtcaataatttctaacggcttatttaccatcaatcaatcgattcattgaaaaggagtattcattttctaatatttgattgagtaaacagaacggagcaattcggtcttttttctgttccctctttcttataacaagattgtgatagtttatatctttataacaaaagttttaaagacttgattgttttgaaagaatattttaaaataagattcagtaaaaatgaaagaggttttgaaaatgtctgaaaaacaaatgaaaattttaggttgggtagcgacctttatgtctgttatgatgtatgtgtcttacttcccacaaatcatgaacaatctggctggtcaaaaaggaaatttcatccagcccttggttgctgccatcaactgtagtctctgggtttactacggtcttttcaaaaaagaaagagatatcccccttgcagcagctaatgcaccaggtattatttttggcctagtgacggttattacagctttgatttaaaaggaacagaggagactagttttcagtcttcttttttgtttcaggggaggctatttactttttctagaggataattttttaaaaaacaatctgataaacttaaatagtagaatagtatcagtatgtcacagtattttataagaaaaggtttacagaataagttataatataagtaaatgaacaagcaaataagaaagtgagtagagttatgaccgaaaaactgacttttccggatggtttcttgtggggcggagcgacagctgccaaccagtgtgagggtgcttataatttaaaaggtcgtggattggcgaatgtggatgtcgtccccatcggtccagatcgtgaagccattatcacaggtcagaaaaagatgttttcgtttgaggagggctatttttacccagccaagcaagctattgatatgtaccatcattacaaggaagatattgccctttttgcggaaatgggctttaagacttatcgtctatccattgcttggactcggatttttcctaagggcgacgaaacagtgccaaatgaagctggtctagccttttatgaggatttatttaaggagtgccacaagtatggtatccaacctctggtgactatcactcatttcgactgtcctatgcacttgattacagagtacggtggttggcgcaatcgtcggatgttagacttctatgaaaaactttgtcgcacactctttacccgctataagggtttggtcaaatattggcttaccttcaacgaaatcaacatgattctccatgccccctttatgggagctgggctctgttttgaagaaggagaaaatcaagaactggttaaatatcaggctgcacactatgagttggtagcttcagctcttgcgacaaagattgcccacgaaattgacccagaaaataaggtgggatgtatgttggctgcagggcaatactatcctaacacagcccatccaagagactactgggcagccatggaggaagaccgcaagagttacttcttcattgatgttcaagcgcgtggggaatacccaaattacgcaaagaagcagtgggagcgtgagggaattaagattcaaatgacgttagaggatttggacttgttgaagaatcatactgttgactttgtttccttctcttactatgcgagccgagtggcctcaggggatccagaagtgaggaatatgaccgctggaaatgtctttgcctctatcaaaaatccttatctggaatcctctgaatggggttggcagattgacccattgggacttcgtatcaccctcaatgccatctgggatcgttaccaaaaacctatgttcatcgtagaaaatggactcggtgttatagacacgccagatgaaaatggctatgtagcggatgactatcgaattgcttatttagaggcccacatcaaggctatgcgagatgccatttaccaagatggggttgacttgctcggttatacgacttggggatgtatcgatttggtttcagctggaacgggcgaaatgaacaagcgctatggctttatctatgtggatcgagataatgcgagtcaaggaagtctcaaacggagcaagaagaaatccttctactggtacaaggatgtcattgccagcaatggtgcaagtattgagtagagcacatttgttcactatttttataaaatcttctctctactttatataataggaaaaagagttcaattagacctggctttttgctataatgaggggagaaaaatcagacaggagaataagatgtcagaaccattatttttacaatcagttatgcaagaaaaaatctggggtggaaccaagctacgtgatgagtttggctacgacatcccaagtgaaaaaatcggagaatactgggccatctcagctcatccaaatggagtctctaaagtttccaatggtcgttacgagggaacagacctagctactttgtatgcagaacaccgtgaattgtttggcaatcgtccagaacctgtatttccgcttttgactaagattctggatgccaacgactggctcagcgtccaagttcacccagatgatgcttatggactggagcatgaaggcgaacttggaaaaacagaatgctggtacattatcgcagcggatgaaggttcagagattatctacggtcacaatgctaagtcaaaagaagaactccgccagcaaatcgaggataaaaactgggaggacttgctgacaaaagttcctgttaaggctggagatttcttctatgtgccaagtggcaccatgcatgctatcggggcaggcatcttgattcttgaaacccaacagtctagtgatacaacttaccgcgtctatgactttgaccgtaaggatgataatggcaacttgcgtgaacttcaccttgaaaaatctatcgatgttttgaacattggagagcctgccaatagccgtcctgtaactgttaaagcagatgatttgcgttccactctccttgtatctaatgatttctttgtagtttacaagtgggaaatcactggaaaagttgattttgagaagacagctgattacaccttattcagtgtcttagctggtcaaggtcagctaactgttgacggaaaaaactatccaatccaaaaaggcagccactttatcctaccaagtgatgttgaagcttggattctggaagggcaaggtttggaattgattgttagtcatccataaaaaagaaagggcctgagttcattactcaagtcctttttgattacataaattgggcgataaagaccacgatgatgatgataggaatgataaaacgaagaaggaagagccagacctggaaaagtccctgtttacatgctcgttcatcaaggtgtagttcctccatggcaagagccttcttaaaaatatagcctgtaaagagtgaaaggcagagagcaccaaatggcatgaggagattagaaaccaagaagtccatagcatcaaagaaggtcttcccaaagatatgaacatccgccataacaccgtaagatagggctgaaggaattccaaagacaaaggtcaagattcctaaaatagcactccatttagcacgcttactgttgtcctgattggtgatattacccacattgatttccagcataacaacggaagaagtgaccgtcgcaaagaggaagagcaggaggaagaggatgtagaaaatggttccaaaaggcatcttgtcaaagagctgaggcaagacgataaatagcaagcttggtcccccttcagactggatattgaaggctgacatggctgggaaaatggctagacctgccatgatggataccgagatattcatggctacgatggaaatccctgactgaaccagattggttttcttatccaagtaagaagcataggtcagcatggctgtaacccctagtgagagggcaaagaaagattgtcccagagcatataggagaccagcactggtcagcttagagaagtctggttttaggaagtaaagaaccccttccatggcatttggcaaactgagagaacgaccgatgatgacgacaaagatgataaagagcaggggcatcatgactttcgaagctctttcaatccctttttgaaccccacgtgatacaatgaagatattcaataggataaaggctgcttgagctcctagggcaatggctggatttgaaatgattgaagtaaataactgagcataatcccccgttccaccaatttggaacaattttccaaactcaatgcctagataaaccagaatccatcccccaataacactgtagaaagataagaggataaagagggcaaaggcaccaatccaaccgataaagttgtacttactattcttgccgagttttccaaaggttttgattgctgaaacaccagcactacggccaagggcaaattcagcaagcaggagcgggaaaccgattaaaatggtagaaataagaaagactagtaaaaagcctccaccgccattagcagcagtcatatagggaaatttccaaacggctccaagtccgatagctgaaccagcagatgctagaataaagcctagtttagaacccccattgcgatttttcagaccaatagttaaactcctaa

SEQ ID NO: 60 - DNA, 91167 bp, Streptococcus mitis NCTC 12261 contig6
tttcggacttttactcaggtgaaaattttggcggagtctgggcaaacagaatcgcagattgcaagtagtttaggtagttttctcggacgcaatccaaatccctatcagattaagtttgcgcttagggattcgcgaggactttccttgagctttttgaagcaagctatttcctatttgattgagacagactatcagattaagacaggtctttatgaaaaaggtttccttttgaaaaaggcactcttacagattgctagtcaggttaattgacatttttttgaaactataacccgcgtcaggattatcttgtcgtgggtttcttgctgatttgcttattttatactcaatgaaaatcaaagagcaaactaggaaactagccgtaggttgctcaaagcactgctttgaggttgtaaataaggctgacgaagtcagctcaaaacatgtttttgaggttgcggatgaaactgacgaagtcagtaattatatctacggcaaggcgacgttgacgcggtttgaagagattttcgaagagtattattagaaagtatctcagtgatttcctcatctataagcaaaaaacttgaaaaaagtgaatgtttgcgttatcattttcatatagaaagaaaaagaggtattacagatggctattatcttaccagatcttccatatgcatacgacgctttggaaccatacatcgatgcggaaacaatgcacttgcaccatgacaaacaccatcaaacttatgtcaacaatgccaatgcagctctagaaaaacaccctgaaatcggtgaagatcttgaagccttgcttgctgatgtagaatctattccagctgatatccgtcaagcacttattaacaacggcggtggacacttgaaccacgctcttttctgggaattgatgactcctgagaaaacagctccatcagcagaacttgcagcagcaatcgatgcaacatttggttcatttgaagaattccaagcagccttcactgcagcagcaacaactcgtttcggttctggctgggcatggttggttgtcaacaaagaaggtaaacttgaagtgacttcaacagcaaaccaagacacaccaatctcagaaggtaaaaaaccaatcttgggcttggacgtttgggaacatgcttactacgtgaaataccgcaacgtgcgtcctgactacatcaaagctttcttctcagtgatcaactggaacaaagtagatgaattgtacgcagctgctaaataatgatatgatatatggagggaagaattgttcttctctttttaaggttatattattttggtctgacaaaatcgtcagacttttttcatttttatgagaaacgtgctaactgctagaaattatggtagaataaagtattaagtaatcgtggaaaaaggatatctatgcgaaaagaaattgcacctgaattatacaactataacaagtttcctggtcctgagttccatttacatggggacaaggttgaaacggaagggatagctttttccttggtggaaaatatcaaggatgcctttgatgtgacggcttttaatcagcgtttttcagaagtcttaaccaagtttgattatatcgtgggagactggagcaacgaacagcttcgcctacgaggtttttacaaggatgatcgaacagaagaaaaacttgaaaaaatcagtcgtttacaagactaccttttagagtattgtagttatggttgtgcctattttgtcttatcaaatgaagcccctaagcgagcatcatttgacaagaaaatgcgtaagaaggaagaagaacagccttctagaaaaggaaagaaaccgactcaaaccaaacgaaaaccgaatgcagataagaaaaatagacgtcgtcagaaagaccagcattctcagaaagaggacaaggggcaacgtcattttgtcattcgtcagaagtgagtagagaataaggagaagaaatgaaaccgtcaatttatagtttaacacgtcaaaccatgcaggaatgggttttggagcagggagaaaagaaattccgtgcagatcaaatctgggaatggctttaccgtaaacgtgtccagtcatttgaagagatgaccaacctttccaaggatttgattgctaaactcaatgaacaatttgtggtcaatcccttgaaacagcgtatcgttcaagagtctgctgatggtaccgttaaatatctttttgaattgcctgatggtatgttgattgagacagtactgatgcgtcaacactacgggctgtcagtctgtgtgaccactcaggtcggctgtaatatcggttgtaccttctgtgcttctggtttgattaagaaacaacgtgacctcaataacggtgaaatcgtagcgcaaatcatgctggttcagaaatactttgatgaacgtggtcaggatgaacgcgtcagccatatcgttgtcatgggaatcggtgaaccttttgataactacaacaatgtcttgaatttcgttcgtactatcaacgatgacaagggaatggctatcggtgctcgtcacatcacggtttcaacctcaggtttggcccataaaattcgtgattttgctaatgaaggagttcaggtcaatcttgccgtttcccttcacgcacctaacaatgagttgcgttcaagcatcatgaagattaaccgtgcatttccgattgaaaaactctttgctgctattgagtattatatcgaaacaacaaatcgtcgtgtgacctttgagtatatcatgctcaatgaagttaatgacggtgtagaacaagccttggaattggctgaattgctcaagaatatcaagaaattgtcttatgtaaacttgattccttataacccagttagtgagcatgaccaatatagccgtagtcctaaagagcgcgtcctggccttttatgatacgcttaagaaaaaaggggttaactgtgtggttcgtcaagagcatggtactgatattgatgcagcttgtggacaattgcgttctaatacaatgaaacgtgaccgccagaaagcagtcgcagcagtcaatccttaatgatgaagaagacttataatcgtattttggtctggggagtcattttctatagtatttgtatcgtttacttttgctttactcctcaagaacattctcccgtgggggtggaaactccaggtattcagcatcttggacgcctggtttttcttttgactcctttcaattctctctggaaactgggtgaggtgagtgacataggacaattatgttggctttttctacaaaatatcctcaatgtcttcttactttttcctctgattttccaactcctttatctccttccaaatttgcgtaagacaagaaaagtgatctttttcagttttcttataagcctaggaattgagtgtacgcagttagtcttagattttttctttgattttaatcgcgtctttgagattgatgatttgtggaccaataccttgggtggctatctggcttggcttctctataaacaattacataaaaacaagataaggaattaaaatgagtattttagaagttaaaaatctgagtcatggttttggtgaccgtgcaatttttgaagatgtgtccttccgcctccttaagggagaacatatcggtctggtcggtgccaatggtgaaggaaaatcaacctttatgagcattgtgactggtaaaatgctgccagatgaaggaaaggttgagtggtccaaatatgtgactgcgggttacttggatcaacactcagtccttgctgaagggcagtcggtgcgtgatgtgctccgtacagcttttgatgagctgtttaaagctgaagctcgtatcaatgacctttatatggaaatggctgaagacggtgcggatgttgatgctctcatggaagaagttggcgaactgcaagatcgtttagagagtcgtgatttctataccttggatgctaagattgacgaagtagcgcgtgcccttggtgtcatggactttggcatggatacagatgtaacttctttgtcaggtgggcaaagaaccaaggtgcttttggcaaaactcctccttgaaaagcccgatatcttgcttttggacgagccaaccaactacttggatgctgagcatattgactggctcaagcgctatctccaaaactatgagaatgcctttgtccttatttcacacgatattccattcttgaacgatgttatcaatatcgtctatcatgtggaaaatcaacagctgacgcgttactctggtgactactaccagttccaagaagtctatgctatgaagaaatctcagctagaggcagcctacgaacgtcagcagaaagaaattgcggaccttaaggactttgttgcccgaaacaaagcgcgtgttgcaacacgaaacatggccatgtctcgtcagaagaaattggataagatggatattatcgaattacaaagtgagaaaccaaaaccatcctttgatttcaaatcagctcgtacgccagggcgctttatcttccaagccaaggatttgcaaattggttatgatcgtcctctgaccaagcctttaaatcttacctttgaacgtaatcaaaaggttgctattatcggggcaaatggtatcgggaaaacaactctcttgaagtccctattgggcattattccaccaatcgctggagaggttgaacgtggagactacctagaacttggctactttgaacaagaagtagaaggtggcaatcgtcaaacaccactagaggctgtttggaatgcctttccagctcttaaccaagcagaagttcgtgcagcccttgcccgttgtggtttgacaactaagcatatcgaaagccaaattcaggtcttgtcaggtggggaacaagccaaggttcgtttctgtctcttgatgaatcgtgaaaacaacgttttagtgctggacgagccgaccaaccatttggatgtggatgccaaggatgaactcaaacgcgctctcaaagaatacaagggatctatccttatggtctgccatgaaccagacttctatgaaggctggatggaccaaatatgggattttaataatctaacttaaaaatgaggacaaaaaaatacagtaccgaatgtggatactgtattttttggtttttaagatttaaaatcgtagtctttcaccacttcgatgctgtcgattgtgatagcagtagttggcttgtctttttcatctttttcggctttggcaattttatctacaacatccataccgtcaatcacttgaccaaatacggggtgtttgccatctagactagggtttcccccttctttataggcttcgatgattttctttggatacttgtttgtagggagtttagcagaggtatctgtagagttttggttgatgaagaattggctaccgttggtgtttggttgaccagtattagccatagaaagagcaccacggatgttatagagataaggagtaatctcgttcttgaaaccagttcccttatcttttgtcttatccttgtcatgccagatggactgaccacctgtaccgtctccctttggatctccagtttgaaccatgaagccatcgatgacacggtggaaggtaatgccgttatagtagccttctttggcatgagtgaggaagttttcaaccgctaaaggagcgagtttagggaagagtttgatacggatatctccttgatttgtgtggagaatcacttcagcttcatcttcagcaacttctttagatagttgtgggaaattggcgttttcgtttgttaaagcatcgtttaactccttggcagattgggcagctgctttggaactttcttcagcagcaagactggaatcaacatagtcatcaccacgcaaactacgttggatgttgctacatccagctagagctacagtggatagtaaaagaagtgttgctatttttttcattctattcctctcaaaaattcatttctaccattgtaccctaaaaggaaggggatttcaaatattagtgacaagacagtttaagaggaagctaaccagaaagtcgcttgcttaggggcatcaatgccataagtatactcaaagtattttggaaccagatcttaagaaagctcgtaaagcatcacaattagtaaacgttaattcgaaagaattactatattttaaaagagcacattttcaaaggattttttcttttgccttcaattcctaattaatcaatgaatttaatactaggtctcgaaaagaattatgcttcctctttctgtctgagttcaaagaggtcttctactttcagattaaaaacttgagcaattttaagagccatttctagcgaagggttgtaacgattattttccaagtgcagaattgtctcgcgtcgcatgccgatgcggtcggctaactcctgctgggtcatgcctgtggactcacgaacagatttgagattagtaataatcttgctttctttggccatgcttatcctctacgttccaagataaaatagacaaccgcaaagatgcaaatcaagacagctatgttaataaatatctgtcccatgtaaagagtgagagaccccatatacccaatgataactgctaggatcatcagtgcgcctagtataaaaacaaacatcaagctagctgccttggctaaattagcataaaagcgttcgtccggagtttccttgacattttttaaagagaaaaaaccaaatataatcacttcaataacgaggctaattcccaaaatccattctttaataccagaacttacgctaggggtcgcaacccaaattcctactgtataaaaaatgcttgctgcaaacacaagtatcgtgtaaagcttagcagacaagtcaaaaataatctttcccttacctttctgactcttatgtagccagctacaaatagctacaatttgacctgtcactgaaataccagtaataactaacttgggtccccaactaagattagaaccaaataaaacagtaaaatcaataaagagagctacggcaatcactgcaatgaggccacgcattttttgattttttttcatgatagactccttttttattttataaatatataacacttaaattttatgttataaatatatcacatttaaatttagaaagcaagaatttatgtgccaaggtggcaattatttggaaaatctagatactctatgaatctctacttttttcttagactgttataaagtctgtcagaataagctttgtaggtgtagaagttagtttttacagaactaaattattctcctatttagaatctattaattcatattttataaattaattagtagatatcgttcttaaaatccttgatatttcgtttgggaacgggcttaggatttaggagccaagtattcaaatctcgttcaggcgatatgaagggtttgacttggtggtctttataaaatgtttctaaaaaaggattcatgacattctctttctgatttttctttaaaaatataacaaatttctaaaaggtttaagaattttatagtctgtcaagtttttttcttgacacctgccagaaatctgctataatagaacatgtgctaaatagcttagctatttcaccgaaataaaaaataagaaaagagactttaaaaatggcagttaaaatccgtttgactcgtatgggttctaagaaaaaacctttctaccgtatcaacgtagcagattcacgttcaccacgtgacggacgtttcatcgaaacagttggaacttacaacccacttgttgctgaaaaccaagtaactttgaaagaagaccgcgttcttgcatggttggctgatggagctcaaccttcagatacagttcgcaacatcctttcaaaagaaggtgtattgaagaaattccacgattctaaattctcaaaataagtttaaagtaggttgacagatggatacgattgaaaatctcattattgcgattgtgaaacccttgatttcacaaccagatgccttaactatcaagattgaagatacaccagagtttttggaatatcatttggatcttgatcaaagcgatgtgggtcgtgtaatcggtcgtaagggtcgcactatttctgcgataagaacgattgtctactctgtcccaactgaagacaaaaaagtaagaatcgttattgacgaaaaataagaagggcgggacggatgtctcgctttttttgtgtggagaagtgtaaaatagcatccatcaagtaacagcataatcgggatttggaaggatttttgaagggggactggaaaagaatgaacattgattgtattttaaacatagattgggcaatgtacattgattggttattgcgaattttacagatttcgacttttataggtgtaattttaaaaattagttttcagaataaggcctatatcaataatatcgaaattcaggtaattaaaccaatcgaatttgattccttacatacgagatttcatcatatatatgagtttaaacatgatgaaaatgataaacattataaccatttgattttttatccaaaggaagttgatattgaaattatagaattttattctttaatctatgattcaaaaagtaatcgtttagttgataatgataaactgcatacagttaaaaatttaaagaattatacatgcttattgattcatacaaatttaccagagaatatgcctagtttaagaatgaaatggaaaacaagtcagggtgaaattggcgagtatacattttatagtaatatgtataatgggaatgtgaatatctcatctttcaaatataaattaacattaaagaggaaactattagcactttttggactatagcgacccctctatgtatcttcctccaacttgagaaaatccttggaacgtgttaaaataaaggataaggatttttaataattcattatatagaacgagtggatttctttatgaagaggattgaagtatctacagaaattggtagtctctctgttacttatcaaaagcaaaagaaaatgctagtttgtttaagtggcgcaggtttgctaccaagttatgaaaatttttcacttatacttgaaaaacttcctcctacaattggttatttgactattgattttccgaacacaggtaggagtccgatgaatgaccaagctggaaaaaatctggataatcttgcagatgcagtttatgaagtacttgaagaattggcgatttctgaatatatactttgtgtacatagtttgagtggaattttagcttgtaaattgctcaagaaaccaattaagtgtcaggctttagtagcaattgaaccgacaactaaaaacgtcatgtttgctgatttttcagaaaattcttatccagaaatggaagagcagatgaggctgattgacgagtgtggtcctgaactttattttaagaacttaactcaagcaacatttagacctgaaattaataaagaaatctgggaaataatgcagggaaaaggctcagagttggaaaatcaagatccaggatttcaaatatctggagagattactgaggaagattttgagaatttgtcgatagaaacttgtacccctgtatttattttttgtcagccttatagagaaaaagagtacagagaatcagaatattggacttccaatactaaactcattttaggagggaatcaccattatttacaatggtcagaatcagaaaaaattgcgactattattcgagaattgttagaataagatggatagaaataaagtacaggagacaagatgaactactttaatgttgggaaaatcgtcaatacgcaaggattgcagggtgagatgcgagtcttgtctgtgacggattttgcagaagaacggtttaaaaaaggtactgagctggctttgtttgatgaaaaagatcagtttgttcaaacagtgaccatcgctagccaccgtaaacagaagaactttgacattattaaattcaaagatatgtaccatatcaacgctatcgaaaagtacaagggatacagtctcaaggttgctgaggaagatttgaatgacctagacgatggtgaattctactatcacgagattatcggtttggaagtctatgagggtgataacttgattggaaccatcaaagaaatcctgcaaccaggtgctaacgatgtctgggtggtcaagcgaaaaggcaagcgtgatttgctcttgccttatatcccaccagtgattctcaatgttgatattccaaataaccgagtcgatgtggaaatcttagaagggttagacgatgaagattgatattttaaccctttttccagagatgttttctccgctagagcactcaatcgttggaaaggctcgagaaaaggggctcttggatatccagtatcataattttcgagaaaatgctgaaaaggcccgccatgtcgacgatgagccctacggaggcggtcaggggatgttgctccgagcccaacccattttcgatgcctttgatgctattgaaaagaaaaatccgcgcgtcattctcctcgatcctgctggaaagcagtttgatcaggcttatgctgaggatttggctcaagaggaagagttaatctttatctgtgggcactatgagggttatgatgagcgtattaagaccttggtgacagatgaggtttctctgggagactatgtactgactggtggtgagttggcagctatgaccatgattgatgctacggtacgcctgattccagaagtgattggcaaggagtctagccaccaagatgatagtttttcttctgggcttctcgaatatcctcagtacacacgtccctacgattatcgaggtatggttgtgccagatgtactgatgagtggacaccatgaaaagattcgtcagtggcgcctgtatgagagtttaaagaaaacctatgaacgcagaccggatttgcttgaacattatcaactgacagcagaagaagaaaaaatgctggcagaaattaaagaaaacaaagaataaaggagatacctatgcaagtaatcaaacgtgatggagaaattgctgaatttaatccagataagatttaccaagctatcttaaaagcagcccagactgtctatgtattgacagatgatttacgtcaaaaccttgcacaagtcactaagaaagtggttttggatttggaagaggccaaggtggaacgtgcgaccatcagcatgattcagtctttggttgaacatcgtttactgggtgcaggttacattaccattgcagaacactacatttcctatcgtctacaacgtgacttggaaagaagtggttatggagatcacatcgcggttcatttacattttgaacaaattcgctaagaaaaaagagtgggatgaagcaactacatctcactctttcttaaatctatttttttgggctgtttggacagttgaagggacaaatcgcaggcgttgaatatcgcttatacggataatacgggtcacatttttggcaaaatttttcacaataatttgctggcgttgttgatcgtatttgatgatatcacctgtaaaacttgtctcagacaagataaggtgaacagcggtttgtttctggatagcctcttcaatagtagctgtaagggagttgctttcagtctggtctggttcttcatgtccatttaaaaagtcatgtattttatctagaacttgctggaatttatgtctcatagtggcctcccttcttttatatcaatattatataaaattttcctaaaatctacaagattttacgaataaactaatgaaagctaaaaaaggagaagaaaatggcagaatttacatttaaaatcgaagagcacttgttgactctttctgaaaacgaaaaaggttggactaaggaaatcaaccgtgtgagctttaatggtgctcctgcaaagtttgatattcgtgcttggagcccagatcatactaaaatgggcaaaggaattactctctcaaatgaagaatttcaaacaatggtggatgcctttaaaggtaactaagttgtcaaaataaaagaaaaggatattgagtcatgacaactcgatatccttttttagttagtaaagtaagcctgatttttaaggcgttgaagtaggggacgactaataaaactaatagccagaagtttaccaaggtctggaatgataaagggaatgacccccacaacaagagctttttcaaatgccattccagccaggaaatgcaagctgagaatcccgccgacaaagacaagggcatcacccaagaggtttgctagaaaaattctgacaaaaccactatcactgttagttagagaagaggtaagtccagaataaacaagataaaaccaaagatagcccgcagtagggccaactaaagcctgaaatccggctccacctcctgcaaagacaggaagaccgattgcacctagaagaagatagagtccaacagaaagtacagcctctctaggtctaaggacagtagcaatcaagccgattgcaaagttttgcagagtgaagggaacaggtccaattggaagactgatttgtgccaaaacagcaatgagagcagccccaatagcagggatagcataaacgtgagcttttttcaaaatagttaacctcttttctgatgtatagtaactattatactcgtggagcaattattgtcaaccaattttttaaaataaggtaacaaaaactgtaacggccgatttgctgactgggtaagttgttttcatcatttcgtaaaacatcaaaaaagaagcagacacatttgtatcggcttcttttttttcgattaacgcatagttacaaattcttcagatgcagttgggtgaatcgccacagttgcgtcaaagtcggccttggttgctcccattttgatagcaacagcaaatccttgaatcatttcatcaacaccatagccaattccatgaagtccgacaactttttcttctgaaccagctgtaatcaatttgaaacgagtttcttgacggttgtcagtgcaagcagagtacatagacgtaaagcttgatttgtaaaccttgatttggtcttgaccgtattctttaatagcttgctcttctgtcaaaccaacagttccgatagcagggtgtgaaaagacgacagttggaatagttgagtaatccatttttgcagtagtttttccgttaaagagacgttcagatagggtacgtccagctttgatagcaactggagttagttctttttcacctgttacatcacctagagcgtagattccttcaataacagtattttggtattcatctacttggataaagccacgttcgttcagagttactccagctttttcaagttgcaagcccttaacgtttggacggcgaccagtagcccagataacttgactagctgtgtgactagtaccatcttcgaaatgaatggtaatgccttcagcagttttttctaacttaacagggactttgtgagtgtgaagtggtaagtttgttctttccatttccttgaccagaccttcaacgatgtaagaatcaaaaccacgtaaaggacgatcacggcgaacaaagaggtctgtcttgacaccaaaagtgtggagtacgccagccaattcaacggcaatataaccagcgcctagaatagcaactgactctggcaattcttcccaagcaaatacatcatcagaagagccacctagttcagcaccaggaacgtttggaatactgggatgggcaccagtagcaatcacgatatgttagcacgaatcagttcaccatttacgctgacagtatgagaatctacaaattcagcatgaccttcaatcaaatctacaccgttgcgtttaaaactgccatcataagaagaacgagcgcgatcaatgtaggcttcacgattgcgacgtagggtagcgaagtcaaagttaagatcagtagtcttaaagccgtagtcttctccaaattgatggaaagtytcagcgatttgtgctccgtaccacatgatttttttaggaacacaaccgacgttgacacaggttccacctaatttcttttcctcaataacggctgctttggctccatgttcaccagcacggttcatagtagcaattcctccgctacctccaccgatagcaatgatatcatattctctcattaaaaactcctttgtactcttttaaatagtagagtgtcattttttgatagtcatattctatcttttttttgatgtgattgcaaaaatctgctacgttaaaaaaaattaaagaaaaggcttgcaaaaaagaaaaataaagtgtattatataactagtacaatgataataaaaataaattccgaacaataagtgaatcctgaaatgtcattatttcgttctgaactgttattgtttatattttgtaatttttgtataatattgttaagtactttaaatcaaaaaggagtttcattatgaaaaagaatcgtaaagctaaaaagtggcaattgtatgcagcaattggtgctgcaagtgttgttgtattgggggctgggggcattttgctctttagacaaccttctcaaaactgctgtaaaagatgagccaactcatcttgttgttgctaaagaaggaaccgtggcatcctctgttttattatcagggacagtaacggcaaaaaatgaacaatatgtttattttgatgctagtaagggagatttagatgaaatccttgtttctgtgggggataaggttagtgaagggcaggctttagtcaagtacagtagttcagaagcccaggcggcctatgattcagctagccgagcagtagctaaggcagatcgtcatatcaatgaactcaatcaagcacgaaatgaagccgcttcagctccggctccacagttaccagcaccagcaggaggcgaaggagctgcagggcaaactccagctccagtctcaggaaatgcagtttcatctattgatgcacaactaggtgatgcccgtgatgctcgtgcagatgcagaagcgcaattaagtaaggctcaaagtcagttggatgccatgacggttctcagtaccctggagggaactgtggttgaagtcaaccacaatgtttctaaatctccaacaggagctagtcaagtagtcgttcatgtcgtaagtaatgaaaacttgcaagttaagggtgaactatctgaatataaccttgccaacctctctgtaggacaagaagtaacctttacttctaaagtttaccaagataagagctggacaggtaagattagctatatctctgactatcctaaaactagtggtgaagcagcaagtgcagctactgccgcaacaggtggtaattctggttctaaatatccatataccatcgatgttacaagtgaaatcggtgatttgaaacaaggattctcagtaagtgttgaggttaagaataagagtaaagccattttggttcctctaacaagtgttgtgactgaaaatgataagaactatgtctgggtgcttgacgagcagaaaaaggccaagaaagtggaagttggtttgggcaatgctgatgcagacaaccaagaaatcacttcaggtctgacaaatggagtcaaggtcatcagtaacccaacgtcttctctagaggaaggaaaagaggtgaaggctgatgaagcaactaattagtctaaaaaatatctgcagaagctaccgtaacggtgaccaagaactgcaggttctcaaaaatatcaacctagaagtgaatgagggtgaatttgttgccatcatgggaccatctggttcgggtaagtctactctcatgaatacgattggtatgttggatacaccaaccagtggagaatattatcttgaaggccaagaagtagctggacttggtgaaaaacaactagccaaggtccgcaatcaacaaatcggttttgtctttcagcagttttttcttctatctaaacttaacgctctgcaaaacgtagaattgcccttgatttacgcgggagtttcggcttcaaaacgtcgcaagttagctgaggagtatttagacaaggttgaattgacagaacgtagtcatcatttgccttcggaattatctggtggtcaaaagcaacgtgtagctatcgcgcgtgccttggtaaacaatccttctattatcctagcggacgaaccgacaggagccttggataccaaaacaggtaaccaaatcatgcaattattagttgaactgaataatgaaggaaaaacaattattatggtaacgcatgagcctgaaatcgctgcttatgctaaacgccagattgtcattcgggatggagttatttcgtctgacagtgctcagttagaaaaggaggaaaactaagatgcagaatctgaaatttgccttttcatctataatggcccacaagatgcgctcttttctcactatgattgggattatcattggtgtttcatctgttgttgtgattatggctctgggagattccatgtctcgtcaggttaataaaaatatgaccaagtcacagaagaatatccatgtctttttctcgcctatcaaaagcaaagatggttcttttacccaaaagcaatcagctttgacggtttctgggaaagaagaggatgttcctgtggagccaccaaaaccacaagaagcttgggtcaaggaggctgctaaagttaaaggggtggacagttactatgtaaccaactcgaccaataccaccctgtcttataaagacaaaaaagtggagcgagctagcttgacaggtggaaatattacttacatgaaggcggttgaaaatgaaattgttgcaggccgcagtttcatagctcaggattataaagatgtggccagtgtcattttactagaccaagaacttgctaatagtctgtttggatctgctcaagaagctgttaaccaggttatagatgttggtggctttagctatcgtgtcattggtgtctataccagcgatgaggccaagactgccaagacttttggtattggtggacttccgattacgactaatatttctcttgccaataacttcaatatggatgaaatttctgatattgttttccgagttaatgataccagtttgacaccaactgtaggaccagaattagctagaaaaatgaccgaaattgctagtcttcaacaaggagagtatcaggtggcagatgcgactgcagccttccaagaagtacaacaactttttggatttataactacgattattagtgccattgcaggaatttccctttttgttggaggaactggtgttatgaacatcatgctggtttcggtgacggagcgtacgcgtgagattggtctccgtaaggctttgggtgcaacacgtgccaatattttaattcagtttttgattgaatccatgattttgaccttgctaggcggagttattggtctaaccattgcgacaggcttaacagctatagctggtctactcttgcaaggattgatagcgggtatagaagtaggagtatcaatcccagttgccctatttagtcttgcagtttcggctagcgtgggtatgatttttggagttttgccagccaacaaggcttcgaaacttgatccaattgaagcccttcgttatgaataagttaaacaagatggacactcgtctatcttgtttttgtatggatttccctatcgaaaatcagtaaaaatgtgatataatgaagtgttagaaaaacaggtttcatttgcctggaaaggaaaaattatgtctgaaaagaatttttatattacaacaccgatttactatccatctggtaaacttcatatcggttctgcctacacaaccatcgcttgtgatgtcctagcacgttacaaacgcctgatgggctacgatgtcttttatctgacaggtcttgatgagcatggtcagaaaatccagcagaaagctgaagaagctggcatcacacctcaagcttatgttgatgggatggcagttggagtcaaagaactctggcaattactggatatctcatacgataaattcatccgtacaacggatgattaccatgaaaaagttgtcgcacaagtctttgaacgcttgctggctcaagatgatatttacttgggtgaatactctggttggtattcagtatcagatgaggaattctttacagaaagccagcttgcagaagttttccgtgatgaagctggaaatgtgacgggtggtatcgctccatcaggtcatgaggttgaatgggtttcagaagaatcttacttccttcgcctcagcaaataccaagaccgtctagtagaatttttcaagtcccatcctgaattcatcactccagatggtcgtctgaatgaaatgcttcgcaacttcatcgagccaggtttggaagatttggcagtttctcgtacaacctttacatggggtgttccagtaccatcaaatccaaaacacgttgtctatgtttggtttgatgctctgctcaactatgtgacagctcttggctacgatcaagacgaacacgctaactttgacaagttctggaacggaacagtcttccacatggttggaaaagacatccttcgttttcactcaatctactggccaatccttcttatgatgttggatatcaaattgccagaacgtttgattggtcatggttggtttgtcatgaaagacggtaagatgtctaagtctaaagggaatgttgtctatcctgaaatgttgatagagcgttttggactagatccacttcgttactacctcatgcgcagccttccagttggttcagacggaacctttactcctgaagactatgtaggccgtatcaactacgaattggccaatgaccttggaaacctcctcaaccgtacggtttctatgattaacaagtactttgatggtcagatccctgcctatgtagagggtgtgacagagtttgaccatgctcttgctcaagtagcagaacaatcaatcgcagactatcatacacacatggaagcagttgactacccacgtgctcttgaagcagtctggactctgatctctcgtaccaataaatacatcgatgagaccgccccatgggtcttggccaaggatgaagctctccgtgaccaattagcaagtgtcatgagtcacttggcagctagccttcgtgtcgttgctcacttgattgagccgtttatgatggaaactagtcgtgcagttttgactcaacttggtttagcagaagttgctagccttgagaacttgaacttggctgacttcccagcagatgtgactgtagttgccaaaggaacaccaattttcccacgtctcgatatggaagaagaaatcgcctatatcaaggaacaaatggaaggcaacaaaccagcagtcgaaaaagagtggaacccagacgaagttgagctcaaactaaacaaggaagaaatcaagtttgaagactttgacaaggttgaaatccgtgtcgcagaagtcaaagaagtgtctaaagtagaaggttcagataagttgcttcaattccgcttggatgctggtgatggtgaagatcgtcaaatcctctcaggaattgccaaatactatccaaatgaacaagaattggtcggcaagaaagtccaaattgttgctaacctcaaaccacgtaagatgatgaaaaaatatgtcagccaagggatgattctctcagctgaacatgatggaaaattaacccttctcacagttgatccagctgtaccaaacggaagtgtgattgggtaaaaatagacaggactagttcatgctagttctgttttttatttaactattatgctttacaaactagtgtgaaagtggtatattataaatgaagttactagtaggtattacaaaatagattagaagggagaagtgatgaaagaaactcagctattaaaaggtgttcttgaaggttgtgtcttggatatgattggtcaaaaagagcggtatggttatgagttggttcagactttgcgagaggctggatttgacactatcgttccaggaactatttatcctttgttgcaaaagttagaaaaaaatcaatggataagaggcgacgtgcgcccgtcgtcagatggtccagatcggaagtatttttcgttaactaaagaaggagaagaacgtgtctcagtcttttggcaacaatgggacgatttgagtcaaaaagtagaaggaattaagaatggagggtaaaccataaagaaaatgaagtattatgaagaaacaagcgctttgctacatgagttttctgaggagaatcaaaagtattttgaggaactgtgggatagttttaatcttgctggatttctctatgatgaggactatctcagagagcagatctatttgatgatgctagatttctcagaagcagaacgagacgggatgagtgcagaggattatctaggtaagaatcctaaaacaataatgaaagagatgctcaaggaagcacctcgcagttctatcaaagagtcccttttgacgccaattcttgtcctagcggtattacgctactatcaactattaggtgattttctaaaggtcctctcttaacagtcaatttgcttacgtttttaggccaacttcttctttttctggtcggatttgggcttgtggctacaattttacgaagaagtttagtccaagattctcctaaaatgaaaattggtacctatattgtcgttgggattcttgttctgctagttgttctgggatatgtaggaatggcaagcttcatacaagaaggagccttttatcttcctgctccctgggatagtttatctgtatttacgatttcgctggtcatcagtatttggaattggaaagaaccgatttttcgtccctttgtcagtatgattgttgcccaccttattgtaggttctctgctccgttactatgagtggatgggcatttcaaatgttttccttacaaaagtcatacctttagctgtcctctttattggaatctttgtcttgttccgtgggtttaagaagataaaatggagtgaaatatagtcaaaaagccgttgcaaagcggttttttgttataatgaagggaagaatgttagaaattaaaggagaaaaatttgatgagatacataactcttggtcaagatgacaaagaattatcagaaattgttctcggaatgatgagaataaaagataagtctgttagagaagttgaagagcttgtagaaacagcactttctgttggaatcaatgcttttgacttagctgatatatatggtcttggtcgttgtgaagaactgttaggtcttgtcctaaaaaatcgtccagatttaagagaaaagatgtggattcagtccaaatgtggcattcgcattgaagaatttacctattttgatttttcaaaagagtatatattacaatcagttgatgggattttagaaagattgcaggttgattatttagatagcttgcttcttcatcgaccagatgctttgatggaagctgaccaagtagcagaagcctttgatatcctttataaacaaggtaaggttcgaaattttggagtttctaatcaaaatcctatgatgatggagttgcttaaaaaagatgtcaagcagccgttagctgttaatcagctacaattgagtgtggcttttacaccaggattcgaatcaggttttcatgttaatatggaagatagtcaagcagctatgcgagatggcagcatttttgaatattgcaaattacacgatgtggtcattcaagcatggtctgtcttacaattcgggtatttcaaagggaattttgttggaaatgagaaatttcaagctttaaatcaagtacttgatcgtttagctactaaatatggagtaacctcttcaactattgccatttcttggatattgcgttatccagcaaaaatgcaggcagtcgtaggcaccacaaatcctaagcacttgagagaagttagccaagcgggaaactttagcttaacaagaaaagaatggtatgaaatttatcttgctgcagggaataatttgccgtaagtagaagcagatgtaaataaatcacagtcaaaaagctgttgtaaagcggttttttgttataatgaaagggagaattattgatattaaaggagaaaaaaatgacatttgaagagattctgcctggattgaaggctaagaaaaaatatgtacgtactggttggggaggtgcggaaaactatgtgcagctttttgacaccattgaacaaaacggggttgctcttgaagtgacaccttatttcctaatcaacgtgtctggagaaggagaaggtttttccatgtggagtccgacaccttgtgatgttttggcgacggattgggtagaagtgcatgactagacgtgtattgattacaggagtgagttcagggatcggcctagctcaagctcgcctctttttagagaatggctttcaagtttatggagttgaccaagatgaaaatccgctcttagagggtgatttccacttttttcagagagatttgaccttggacttggagcctatttttgactggtgtcctcgggtggatgttttgtgcaatactgctggagttttggatgcttacaaaccacttttggaacaatcagcgcaggaaattcaagagatttttgaaatcaactatgtgactcctgttgagttgactcgctattatttgacgcaaatgctggaaaataaaaaaggaatcattatcaatatgtgttctattgcttcgagcctagcaggtggcggtggacacgcctatacttcttcgaagcacgccttggcaggatttaccaagcagttggctctagactatgcgggagctgggattcagatctttggtatcgctccaggagcagtcaagacagctatgacagctgacgactttgaaccaggtggcttagcagactgggtggctagtgaaacgccaatcaagcgctggattgagccagaggaaatagcagagattagccttttcttagccagtggaaaggcctctgccatgcagggacaaattctgacaatagatggtggctggtctttgaagtagggagaataaagttaataaaaaggagcacccatgacaccgcaagaaatgtggaatgcatacaagaaaattgatccctctatcggagatgaggtagatgcctgggcttttggagtggaaacagatctcttggcagatttggtgtttaaaggcgaaaagacagcaaccgcctcagcctacgacctctacgcactagaagacgaacctcttccacaagaagggaccttcgatgttattttagatagtcaaaatcaggctgtctgcattgtcgaaattacaagggtttccgttcagccctttaatcaagtttctgcgcaacatgcctataaggaaggtgagggagacaaatctttgacctattggcgtcaggttcatgaggcttgtttcgccgagtggctgagagaagcaggactgacttttacacctaacagcaaggtcgttttagaagaatttcgcaaggtctacccactgtaggctattagaaggaagaaagttttggaaatcaccgtccaatccttttttctcaagcaaaacatgatataataagtttgtttgaagaagagctctagctcttaaacttagaataggagaaaactatgcaagcagttgaacattttattaagcaatttgttcctgaacattatgatttatttttagacttgagtcgtgagaccaagactttttctggaaaggtgactattagtggtcaggcacagagtgaccgcatttcccttcatcaaaaagacttggcaatctcttctgtagaagttgaaggggaagctcgcccatttacagttgatcatgacaatgaagctcttcatattgaattagctgaggctggtcaagttgaagtggttatcgctttctcaggaaaaattacagacaacatgacagggatttacccatcttactacacagttgatggagtcaagaaggaagtcttgtcaactcagttcgagagccattttgcgcgagaagctttcccatgtgtggatgagccagaagccaaagcaacttttgatctagctcttcgttttgaccaagctgaaggtgaattggccttgtctaacatgccagaaatcgatgttgaaaaccgtaaggaaacaggtatctggaagtttgagacaacacctcgcatgtcttcttacttgttggcctttgttgcaggtgatttgcaaggtgtaacggctaaaactaaaaacggtaccctcgtaggtgtttattcaaccagagctcatccactatcaaaccttgatttctcactggatatcgctgttcgctctatcgagttttacgaagattactatggagttaagtacccgatccctcaatctctccacatcgcccttcctgacttctcagctggagctatggaaaactggggtctcgtgacctaccgtgaagtttacttggttgtcgatgataactcaacttttgctagccgtcaacaagttgcccttgttgtggcacatgaattggctcaccaatggtttggtaacctggtaactatgaaatggtgggatgacctttggctcaatgaaagcttcgccaacatgatggagtacgtctgtgtggatgctattgaaccaagctggaatatctttgaagatttccaaacaggtggtgttccgtctgccttgaaacgtgatgcgactgatggtgttcaatctgttcacgtcgaagtgaaacatccagatgaaatcaatacgctctttgacggagctatcgtctatgccaaaggaagtcgccttatgcatatgcttcgtcgttggctaggtgataccgattttgccaaaggtttgcatgcctactttgaaaaacatcaatacagcaatacaattggtcgtgacctttgggatgctcttggtcaagcgtctggacgtgatgttgcagccttcatggattcttggttggaacaacctggttatccagttctcactgtcaaagttgaaaatgatgtcttgaagatctcacaaaaacaattctttatcggtgagcacgaagacaagaaccgtctctgggttgtgccactaaacagcaattggaaaggcttgcctgatacactcgaaactgaaagcatcgaaatccctggctatgcagcccttcttgctgaaaacaaaacagcacttcgtctcaacactgaaaatacagcccactacattaccgactatcaaggagatttgttggatgcagttcttgctgacctagttgagcttgataacacaagtaaactgcaaatcgtccaagaacgtcgcttgcttgctgaagcagggcacatttcttatgcagacttgcttccagtccttgataaactcgctaaagaagaatcttaccttgtcgtttcagctgtttctcaagtaatttctgcccttgagcgctttatcgatgaaggaacagaagctgaaagagccttcaaagccttggttgctaaattggctcgtcataattatgaccgtcttggttttgaagctaaagatggcgaatcagatgaggatgaattggttcgtcagttggccatttctatgatgattcgctcaaatgatgcagaagctagtcaagccgctagccaaatcttcgcagcacacaaggagaatcttgcaggactcccagcagctattcgttcacaagttctcatcaatgagatgaaacatcatgagactaaagacttgttagcactttatcttgatacttatacgcacgcaacagatgctgtctttaaacgtcagttggcagcagctcttgcctacagtaaagatgcggacaatatccaaaccttgattacttcttggaaggacaaatttgtggtcaaaccacaagacttgtctgcttggtacttccagttcttaagccatcaagcaactcaggaaacagcatggtcttgggctcgtgaaaattgggcttggattaaggcagctcttggtggagatatgagctttgatagctttgttatccttcctgctcacgtatttaagactcagcaacgcttggcagagtacaaggaattctttgaaccgcaactttctgaccttgctcttagccgtaatatcggtatgggaatcaaggaaattgcagcgcgtgttgacttgattaaccgtgaaaaaactgcagtggaagcagtcgttcttcaatacggaaacgcataaataagcctaaaataaaaagaaaactcagctatctcatgtaaaatgtagagagttgagttttttttaaggcaaatttggtataatggttttaataaggaggagtttctcatgataaaaatcttattagttgaggatgacctaggcctgtcaaattcagtatttgactttttagacgattttgcggatgtcatgcaggtatttgatggtgaagaaggtctctacgaagctgaaagtggcgtctatgacttgattttgctcgatttaatgttacctgaaaaaaatggctttcaagtcttgaaagaattgcgtgaaaaaggaattacgacaccagttctgatcatgactgccaaggaaagtttggatgacaagggacatggatttgaattgggagcagatgattatctgaccaaacctttctacctagaagaactcaaaatgcggattcaagcgcttctcaaacgttcaggtaaatttaatgaaaacaccttgacttatggaaatattgtggttaatttgtcaaccaatactgttaaagtcgaagatactcctgtcgaattgctaggtaaagagtttgatttattagtttatttccttcaaaatcaaaatgttattttgcctaagactcagatttttgatcgtctatggggatttgatagtgacacaacgatttcggttgtcgaagtctatgtttcaaaagtccgtaagaaattaaaaggaaccacttttgcagagaatttgcaaaccttgcgcagtgttgggtatattttaaaagatgttcagtaaactaaaaaaaacatggtatgcggatgactttagttattttatccgtaactttggtgtattcactctgattttctctaccatgactctgattattttgcaggtcatgcactcgagtctttatacttcggtggatgataagcttcatggactaagtgaaaatcctcaagcagttattcagcttgctgtaaatagggcaacagaagagattaaagatttagagaatgccgctacagatactagcaagactgagataaaacccaatgtcagttccaacacagaagtcattctttttgataagaattttacccagctcctttctggaaatcgatttttgggattggataagattaagttagagaaaaaagaactaggacatatctatcagattcaggtttttaatagctatggacaagaagaaatctatcgcatgatcttgatggaaacgaatatcagttcggtttcaaccaatatcaagtatgcagctgtcttgattaataccagtcagttggagcaggctagtcaaaagcatgagcaattgattgtgattgtgatggctagtttctggattttgtctttacttgccagtctctatctagctagggtcagtgttcggcccctgcttgagagcatgcagaagcaacagtcctttgtggaaaatgccagtcatgagttacgaactccacttgcagttttgcaaaatcgtttagagaccctttttcgtaagccagaagcaaccattatggatgtgagcgaaagcattgcgtctagtttggaagaagtccgaaatatgcgttttttgacgacaaacttgctgaacttagctcgtagagatgatgggattaagccggaacttgcagaagttccaaccagttttttcaatacgactttcacaaactatgagatgattgcttctgaaaatgaccgtgtctttcgttttgaaaatcggatccatcgaacgattgtcacggatcaacttcttttgaaacaactgatgaccatcttatttgataatgccatcaaatatactgaggaggatggtgaaattgattttatgatttcagcgactgatcgtaatctgtatttacttgtttctgacaatggagtcggtatttccgcagaagataagaagaaaatatttgaccgcttttatcgagtggacaaggctagaacccgccaaaaaggtggttttggtttaggtttatccctagccaagcaaattgtagatgccctaaaaggaaccattactgttaaagataataaaccaaagggaacaatctttgaagtgaaggtagccatccacacaccatctaaaaagaaaaaataaaaatatcgctccagttggggcgatattttggatttatcttctacgttttcgtttgataatagaccgttgaacttttaaaacaagtaagctggatccgattgctgcggcaaaggcaagagcaggtgataattttaatgctaaaaagataaaactaaagatagcaatacagatacaaaaaacagcgatattaacaaaaaataggatttccttgagattggcatcagattgtgcttcaggtgtataatcttgatagcgaggaacctgctggcttaattcttcttgattgtctacctcataggattgtaattttcttacgggcattattctctccttaacagtacatacctattttatcattttttcagcagagaattattacagaaaggttacaataagaataaagtcccttttcatttttaaagaatggctgattttccagaaatgtggtataatttttcttatggaaaagattatcattacagcaactgctgaaagtattgaacaagttgaacaactgctcgaagctggcgtggaccgtatctatgttggtgagaaagattttggccttcgtctgccaacgacctttagtcatgaccaattgcgtgaaatcgctaatctggttcatgatactggtaaagaattgatcgttgcggttaatgccctcatgcaccaagatatgatggaccgtatcaagcctttcttagactttttggaagaaatcaagacagactacattacgattggggatgcaggtgtcttttacgtagtcaatcgcgatggttattcatttaagactatctacgatgcctcaactatggtaactagcagtcgtcagattaacttctggggacaaaaggctggcgcatctgaggctgttttggcacgtgaaattccatcagctgaactcttcaaaatgccagatattttggaaattcctgctgaagttttggtttacggagctagtgttattcaccattctaaacgtccactcttgcaaaactattataactttacacatatcgatgatgaaaagacccgcaagcgtgacctcttcttggctgagccaagtgacccagagagccattattctatctttgaagacaatcatggtacccacatctttgccaacaatgaccttgatttgatgaccaaattgacagaattggtcgagcatggtttcactcactggaaactagaaggactctacactccgggacaaaactttgttgagattgcaaaactctttatccaagcgcgtagcttgatccaagagggcaactttagccatgaccaagcctttttgctggatgaggaagtacgtaagttacaccctaaaaaccgtttccttgatacaggattttatgactacgatcctgacatggttaaataaagtaaactgcaagttgagagaaggaagatgcaaagatttcttctctcaattttttcttatttcttcaccattttcaaagaatcagtaggataggatgctctatttgatgggatttttaagacaagtagtgttcttgagtttgaaaattatcccatgtttgcaggtgccaaatggccctttttttggtataattttttataatgaaaacgattggtaatcgctatgttgtggttgatttagaggcaactagcacaggtagtaaggctaaaattatccaagtgggaattgtcgtgattgaggatggaaaaatcgtcgatcactatacgacagatgtcaatccacatgaacccttggatgctcatataaaagaactgacaggattgacagaccaacgtctggcgcaagcacctgatttttcgcaagttgctagaaaaatctttgacttggtggaggatgggatttttgtagcccataatgttcagtttgatgccaatctcttggcggaaaatttattttttgaaggctatgaactaagaaatcctcgtgttgacacggtcgaattggctcaggtcttttttcctaaactggaaaaatatagtttgccgatattgtgtcgagaattaggaattcctctaaaacacgctcacacagccctttcagatgcccaagctactgcggaattactcttatttctacaggaaaagatggcccagcttcctaaaggtctcttggaacgcttgctggaaatggctgacgccctcctatacgagtcctacctgcttattgaagaaatttatcgaaacaaatctatcctgagttcaccagacttggtcgaagttcaaggactgtatttcaagaaaactggagctcccctggagccacgaaaactatcccaagatttttctaaaaatatttctctgttaaatcttgaagtgagggaggagcaagaaagttttgctaaagaggttggcttgctattgaaagatgagcctgtctctctgattcaagctccgacagggattggtaaaacttatggatatctcttacctgctttgtcccaagtggaaaatcgtcagattgtccttagcgttccgacaaagattcttcaaaatcaaatcatggaagaagaaggtaaacgtctcaaggaagtgttccatatagatattcatagtttaaagggaccacacaattatctgaagttggatgccttttatcgttccttgcaggaaaatgatgaaaatcgcttatttagacgctttaaaatgcaactcttgatctggctgactgagacagagacaggagatttggatgaaattgggcaactctaccgttaccaacattttctaacagaccttcgtcatgacgggaatttatcatctcaaagcttatttgtgacggaagatttttggaaacgtagtcaagaaaaggcacaaacctgcaagcttttagtgaccaatcatgcctatcttgtaactagactggaagataatcctgaatttgtcagtgaccgtttattgattattgatgaagttcaaaagattttgttagctctagaaaatctgcttcaagagacttacgatgtccagtctattatcgatttgcttgataaggctttactggaggagcaaaataaggtccaacaacgaatactagaaagtattcgctttgagtgcctctacttgatagaacaatttcagtctggaaaatctaggaaaaatatcttggattctctgaccaatctccaccagtatttttcagaattagaagtagaagactttgaggagctggttcgctattttacagctgaccgagattactggcttgaagcaattgaaacgagtcaaaagaaaattcaaatttcctctacgaaatcaggacgtattctcctatcttctttagtacctaattcatgtcaagtcttgggagtgtcggctactcttgagattagtcagagagtttctttggcagacctgttaggctatcccgaagctaaatttgttaagattgaagctggtaaaaaacaggatcaagaagtggtcttggtcaaagattttcccctggtaacagaaacctccttagaagtctacgccaaagaggtaactgatttgctgatggatgttcaagatttccagcaacctattttagttctctttactgctaaagacatgcttctagcagtgtcggatttacttccagttagccacttggcccagtataaaaatggggatgttcatcaactgaagaaacgctttgaaaaaggtgaacaacaaatcctgctaggtgcagcaagtttctgggagggagttgatttttcaagtcattcttttgtgattcaaattgtaccaagacttcctttccaaaacccccaagaacccttgacgaaaaagatcaatcaggaactaattcaagaagggaaaaatgccttttatgattatcaattgccaatggccattattcgtttaaaacaggctttaggaagaagtatgagacgtgaacaccaacgttccttaactctgattttggataggagaattgtcggaaagcgatatggcaaacaaattgtgacttctctagcaaaagaagcgattgttaaaaccgtctctcaatccgaagttgatgaggctattgataaatttttaaatgaactttgataaatagtattgtatgaaagtataaggttagtatatatgaaacgttctctcgactctagagtcgattatagtttgctcctgccagtatttttcctactggttatcggcgtggtggctatttatatagctgttagtcatgattatccaaacaatattctgcccattttagggcagcaggtcgcctggatcgccttggggcttgtgattggttttgtggtcatgctctttaatactgaatttctttggaaggttacaccctttctatatattttaggcttgggacttatggttttacctatcgtcttttataatccaagcttagttgcatcaacaggtgccaaaaactgggtatcggtaaatggtgttaccttgttccagccgtcagaatttatgaagatatcctatatcctcatgttggctcgtgtgattgtccagtttaccaaaaaacataaggaatggagacgcacagttccgctggacttcttgttgattttctggatgattctctttaccattccagtcctagttcttttggcacttcaaagtgacttggggacggctttggtttttgtagccattttctcaggaatcgttttattatcgggggtttcttggaaaattattatcccagtatttgtgactgctgtaacaggaattgctggtttcttagctatttttatcagcaaggacggtcgggcttttctccatcaactgggaatgccgacctaccaaatcaaccgtattttggcttggctcaatccttttgactttgcccaaacaaccacttaccaacaggctcaaggacagattgccattggaagcggtggcttatttggacaagggtttaatgcttcgaatctgcttattccagttcgagagtcggatatgattttcacggttatcgcagaagattttggctttattggctctgtccttgttattgccctttatctcatgctgatttatcgtatgttgaagattactcttaaatcaaataatcagttctacacctatatttccacaggtttgattatgatgttactcttccatatctttgagaatatcggtgccgtgacaggtttgcttcctttgactgggattcccttgccttttatttcgcaaggaggatcggctattatcagtaatttaatcggtgttggcttgcttttatcgatgagttaccagactaatctagctgaagaaaagagcggaaaagttccattcaaacggaaaaaggttgtattaaaacaaatcaaataaggagaaaatcatggtaaaagtagcagttatgttggctcagggctttgaagaaattgaagctttgacagttgtggatgttttgcgtcgtgcaaatattacttgtgatatggttggttttgaagagcaagtgacgggttcgcatgcaatccaagtaagtgcagaccgtgtttttgatggtgatttatcagactatgacatgattgttcttcctggaggtatgcctggttctgcacatttgcgcgataatcaggccttgattcaagagttgcaaagctttgaacgagaagggaagaaactggcagccatttgtgcggcgccaattgccctcaatcaagcagggctattgaaaaacaagcagtacacttgctatgatggcgttcaagagcaaatctttgatggtcaatatgtaaaggaaacagtagtggtagatggtcatttgataaccagtcgaggcccctcaacagcccttgcctttgcctacgagttggtggagcaattaggaggagacgcagagactttacgaacaggaatgctctatctagatgtctttggtaaaaatcagtaaaacgggagtcaaactctcgttttttatgtggaaaactcagggaaatcatcgcttttttcataaaaaaatgctataatgaagggtatgaaatatcacgattatatctgggatttaggtggaactttactggataattacgaaacttcaacagctgcatttgttgaaacattggcattgtatggcatcacacaagaccatgacagtgtctatcaggctttaaaggtttctactgattttgcgattgagacattcgctcccaacttagagaattttttagaaaaatataaggaaaatgaagccagagagcttgaacatccgattttgtttgatggagtttctgatttattgaaagatatctccaatcaaggtggccgtcattttttggtttctcatcgaaatgatcaggtcttggaaattttagaaaaaacctctatagcagcttattttacagaagtggtgacttctaactcaggctttaagagaaaaccagatcctgaatccatgatttatttaagagaaaaatatcaaattagttcaggccttgtcattggtgatcgaccgattgatatcgaagccgggcaagctgcaggactagctacccacttgtttaccagtatcgtgaatttaagacaagtattagacatgtaagaaaaaggaataagatgacagaagaaatcaaaaatctgcaggcacaagattatgatgccagtcaaattcaagttttagagggcttagaggctgttcgtatgcgtccagggatgtatatcgggtcaacttcaaaagaaggtcttcaccatctagtctgggaaattgttgataactcaattgacgaggccttggcaggatttgctagccatattcaagtctttattgagccagataattcgattacagttgttgatgatggacgtggtatcccagtcgatattcaggaaaaaacaggtcgacctgccgttgagactgtctttactgttcttcacgctggaggaaagtttggcggtggcggatataaggtctcaggtggtcttcacggagtggggtcctcagttgttaacgccctttcaactcaattagatgttcatgtccacaaaaatggtaagattcattaccaagaataccgtcgtggtcatgttgtcgcagaccttgaggtggttggagatacggataaaactggaacaacagttcactttataccggatccagaaattttcactgaaacaacaacttttgattttgataaattaaataaacggattcaagagttggcctttctaaatcgtggtcttcaaatctccatcacagataagcgtgaggggctagaacaaactaagcattaccactatgaaggtgggattgctagctacgttgaatatatcaacgagaacaaggatgttatctttgatacaccaatttacacagatggtgaaatggatgatatcacggttgaagtagccatgcagtacacaacgggttaccatgaaaatgtcatgagtttcgccaataatattcatacccatgaaggtggaacgcatgaacaaggtttccgtacagccttgactcgtgttatcaacgattatgctcgtaaaaataagttattgaaagacaatgaagacaatctaacaggggaagatgttcgtgaaggattaactgcagttatctcagttaaacacccaaatccacagtttgaaggacaaaccaagaccaaactgggaaatagcgaagtggttaagattaccaatcgcctcttcagtgatgccttttctgatttcctcatggaaaatccacagattgctaaacgtattgtggaaaaaggaattttggctgctaaggctcgtgtggctgccaagcgtgcgcgtgaagtcactcgtaaaaaatctggtttggaaatttccaaccttccaggaaaactagcagactgttcttctaacaatcctgcggaaacagaactcttcatcgtcgaaggagattcagctggtggatcagcaaaatctggtcgtaaccgtgaatttcaagcaatccttccaattcgcggtaagattttgaacgttgaaaaggcaagtatggataagattctagctaacgaagaaattcgtagtcttttcacagcgatgggaacaggatttggtgcagaatttgatgtttcaaaagcccgttaccaaaaactcgttttgatgaccgatgccgatgtcgatggagcccatattcgtactcttcttttaaccttgatttatcgttatatgaaaccaattctagaagctggttatgtctatattgcccaaccaccaatctatggtgtcaaggttggaagcgagattaaagaatatatccagccaggagcggatcaagaaattaaactccaagaagccttggcccgccacagtgaaggacgtgccaaaccaaccattcagcgttataaaggtttgggtgaaatggatgatcaccagttgtgggaaacaaccatggatcccgaacatcgcttaatggcaagagtttctgtggacgatgctgcagaagcagataaaatctttgatatgttgatgggggatcgagtagagcctcgtcgtgaatttatcgaagaaaatgccgtctatagtacacttgatgtctaaaaaatcgggagaagtagttcccttggtctaaaaaatatgatataatcattacgattgtttcaagttaaaaaggagtttaatatgtctggtagtctagtagtatatcttataattgcaattgcaattatattgctgatttcatatgctatagcaatttatgtacggaaacgcaatgaaagtaaattagcaattttagaagagaaaaaagaagagctgtacaatcttccagttaatgatgaagttgaagctgtaaaaaatatgcacttgattggacaaagtcaagtgactttccgtgaatggaaccaaaaatgggttgacctatctcttaactcttttgccgatatcgaaaataatcttttcgaggcagaaggttataacaattcattccgttttttcaaggccagtcatcaaattgaccaaatagagagccaaattactttgattgaagaagatattgcggcaattcgcaatgccttggcagatttggagaaacaagaatctaaaaatagtggacgtgttcttcataccttggacttgtttgaagagttgcaacaccgagttgctgatcattctgaagaatatggccaaggtttatctgaaatcgaaaaacaattggaaaatatccaatcagagttttctcagtttgttactttgaatacttcaggtgacccagtagaagctgctgtaattttggataatgctgagaatcatatcttggctttgagtcacattgttgaccgcctgccagcgattgtaaaaacattatctaaagagctacctgatcagctggaagatttagaagatggctaccgtaagcttttagatgctaattatcatttttctgagacggatattgaatctcgcttccaattgctttatgaagctttgaagaaaaaccacgaaaatattgcacaattagagttggataatgctgagtatgaaaatactcaagttcaagaagaaatcaatgcactctatgatatctttacacgagaaattgctgctcaaaaagtagtagaaggctttgttgcaacccttcctacatatttgaaacacatgaaagatagtaatgctgttttagtggaagatattcaacgattgagtaacaattacctactatctgacacggatgttagtcatgtacacagattacaagctgagttagaatctctggaagaatctgtattggaattaacttctgaacaagaggaatattctgagccatattcattacttgaagaacgtttggaaaacttacaagcaactttgaaagaaattgaggatgaacaagttgcggttagtcaacgtcttgctcagattgaaaaagatgatatcaatgctcgccagaaggcaaatgtttatgtcaatcgtcttcataccattaagagatatatggaaaaacgcaatcttccaggtatccctcagaatttcttacagttgttctttacagcaagtaaccatacagaagagttgatggctgagctagaagaagcccaggtcaatatcgaagctgtaaaccgtatgcttgaaattacaacaaatgatatggaagcacttgaagcagaaacgtataatattgttcaatatgcaacattgacagaacaattgctacagtattcgaaccgttaccgctcatttgatgaacgaattcaggaagcctttaatgaatcattagaaatttttgaaaaagaatttgattaccatgcttcatttgataagatttcgcaagctttagaagttgcagaacctggtgtaaccaaccgttttgttacttcatatgaaaaaacacgtgagacaattcgtttctaaaaaaggctctttgtcaactgtagtgggttgaagaaaagcggctctttgtcaactgtagtgggttgaagaaaagctaagattgagaaaggacacatttcgtcctttcttttttgatattgagagcgataaaaattcgttttttgaagttttcaaagttccgaaaaccaaaggcatttcgcttgataagtttgatgagattattggtcgcttccaatttggcgttggaatagggtagttgaagggcattgacgattttctctttatccttgagaaaggttttaaagacagtctgaaaaagaggatgaacctgcttaagattgtcctcaataagtccgaagaatttgtcaggttccttgttctgaaagtgaaaaagcaagagttgatagagattgtagtggtgtttcaagtcttctgaatagctcaaaagcttgtctagaatttctttatttgttaagtgcatgcgaaaagtagggcgataaaaacgtttatcactgagtttacgactatcctgctgtatgagcttccagtagcgcttgatggctttgtattcatgggattttcgctcaaattgattcatgatttggacacgaacacgactcatagcacggcttaagtgttgtacaatgtgaaatcgatctagaacgattttagcacatggaaaaagctgtttagccaaggcataataaggactaaacatatccatcgtaatgattttcacctgacaacgaacagctcgctcgtagcgcagaaagtgatttcgtatgatagcctgtgttctgccttcaagaacagtgatgatgttgagattatcaaaatcttgtgcaatgaaactcatctttcccttggtaaaggcatactcgtcccaagacataatctctggaagacgagaaaaatcatgcttaaaacggaagtcattaagcttgcgaatgacagttgaagttgaaatagctagttgatgagcgatatcggtcatagaagttttttcaatcaatttttgcgcaattttttggttgataatacgaggaatttggtgatttttctcgacgagagaggtctgtgagaccatcattttagagcaatgatagcacttgaaacgacgctttttaaggaggattttggtaggcataccagttgtttcaaggtaaggaattttcgatggtttttggaagtcatatttcttcatttgacttccacattcaggacaagatggggcctcataatccagtttagcgatgatttccttgtgggtatctctattaacaacatccataatttggacattagggtctttgatatcgagcagttttatgataaaatgtaatggttccatatgattctttctaatgagttgtttcgtcgcttttcattatagatcttatgggactttttttctacacaaaaataggctccataatatttataggggatttacccactacaaatattatagagccatcttttttattgcttaattgtttttaaaaatgcccagttaccaattgattttgatccgtattctaagtccatatagtccagtaatacataatcatttttttcatagaaagaggcattgtttgctgtgcttgtaatgaggcccaagtacttacagccttttgatttgacatagggttcaattccttgtgtcagaaaagtactgcctattccctggcctttatttactgtattgacagctaaagccatcaaataccaatcaaactcacctgattgttctaagtgctttttggaacgttttacaaagtcaaagtatttaaaaagattacgtggtcgaatgtagcgaaaaatttttgttccgccatttcgtagataggatagtatacagaaatccttttgttgcaaaagggcaactgctagtaattctccatcttgttcagcaattaaacagtttccttttttaatatagactctagtaagcagaatttgcaatgtttctacgaaagaaggataggaatcagctttctttaaaccatcaattattatcgttaaaaaaggatagtcaagaaaggacttggctaatagttttccaattttttcgtactcctcaattcttgcctctctatatattatgtctcccatgtttgtttccttagttacctatgaaaccgtgtttgataggattgtaagataaaaaattggagatgatttaaaaagcaagtgagaacctcgttttgtgctgtaaggttcaaaaaactttttaatctctccaaaatgttatttggttggaatcgaaattccaattaatttttctgaatagagggttttgatattggcctcatcaatagaatccttatcaattttacgtttcaagaaaaactcttgaatagcttcgatttcaggttcgcgaatagcacggtgtttgtttgagatgaggatttcatagtgaagcggagcttgggtaaaaataacatcagtattccctgcagaatagacctcaacaagggttgcatctgtactttctagctggctttttacaagttgcgagtgtgagtttgtcgtattgattagcttcataacatttcctccgattttctaattctattatagcactttttaaataaagtagcttgctttatactcaatgaaaatcaaagagcaaactaggaagctagccgcaggctgtacttgagtacggcaaggcgaagctgacgtggtttgaatttgattttcgaagagtattagtcaatcttatgatgttttttccaagattggatggcccatttatggctaccacgtttgagattttcaatagcctcgtcaatagggaaccaggcaatatgattaaagtcttctagtggcttttgcacttctttgaaagaagttgcttcatagaggtaggcaggattgtagtagtaggtgtcacgatgacgagagtagaaatattcgtcagcttgtccgtaataggcaccaatttcagctgtgaagccaagctcttcaatcaattcacgttttagggcttcctgatggttctcaccagcttcaatttcgccacctggtaggaaccaagcgccattgggtgcttgaacaagaacaatttgtttttgttcagcatcaggtataactgcatatacgccatagcgtgaaacatagtctgtattcgcttttttttctccgaaagttgggtttgccattgcattttcctcattatctattatctttattattatcttaatggacaaaggcctagctgtcaagaatttatagttattttagtaaaaaggagcagaaaattttcattttctactccttttctataggatttatacttctttttcagaagtctttacttcagcttttttggcagatttgatttgaatgttacccttgctggtcatcactgccttgaggtctttttcgcttggattttcaaggtagtagtcagtgattgcgtcctcaatatagtcttgaatagtacgacgaagtgggcgtgctcccatttttggatcataaccaaggtcaaccaatttttccttgaccttgtcggttacatccaaatgaatgttgttgctagaaagacgtttgttaacatctgcaagcataagctcgacaatctgaaggaggttatctttgctgagagccttaaattcgataataccatcaaaacggttcataaactctgggctaaagaagttaccgagttcaccaagaacagagttggtacgtccttctctagcagcaccaaatccaacgctagcttctgccttacctgtacctgcatttgaagtcatgatgatgatggcgtccttgaagctaacggtacgtccttgtccatctgttaaacgaccatcgtccaagacctggaggaacatatgcatgacatctggatgggctttctctacttcatccaagagaataagagagtagggattgcggcggactttttcagttaattgcccagcctcgtcatagccgacataacctggaggggcaccgactaatttcgccacactgtgtttttccatatattcactcatatcaaagcgaatcatgctgtcagcagaaccaaagagttcgatagctaattgtttggaaagttctgtcttaccgactccagttggcccaacgaaaaggaaacttccgattgggcggttaggggtaccgagaccgacacgattacggcgaatagccttggcaatcttatcgacagcatcatcttgtccaataacatgagacttgaggtcttcggctagatggatgagttgagattgttctttctcttttaaatcaccaacaggaatattggttttctgctcgataatgtgctcaatggttttctcactaatgataggagtatcttggtctgtgacctttttcttttgcatttccttatacttggcaatctggtcacggaagtaggcggccttctcaaaatcttcttctcgtgtagcttgagatttaagattttcagcctcaatcaagcgctgatcgattactttaggatccacaaaattcaaggtcaagttcatcttagaaccagcttcatctaggaggtcaatggccttgtcaggcaagaagcgatcttggatgtagcgattggacagagttgcagctgcttcaattgcagcatcggtatactgaacgtggtggtagtcttcgtatttcttttgaatgcctttgaggatagtaattgtttcctccactgttggttcatccactttaacaggttgcatacgacgctctagggctgcatctttttcaatgatacggtattcattgagggtagtagcaccgaccaattgcagctctccacgagcaagggcgggcttgaggatatttcctgcatccatattgccatcgcccgcagaaccagcaccgacaatttcatggatttcatcgataaagaggatgatgtcctcacgtttgcgaatttcttccatgagtttttgcatgcgttcttcaaattgtccacggatacccgttccttgaactaagctaaccacatccagacggatgacttgttttccttgtagtttatggggaacatctccatcaactattttctgagctagaccttcgacaacggcagtttttccgacacctggttcaccgataagaacaggattattcttggttctgcgattgagaatttctatgacacggataatctcatcgtcgcgcccaataacggggtcaatatctccacgacgggcaatttcagttacgttgataccaaattcttccagtaggcctttttcttggcttggtggaggagtttgagcaggtccacgattttgggaaccataaccgccatttccaccgtaacctccacctgattgggttgggggagtcggaggagtattgttagaaggcctgaaattgtttaggtcattgaagaaatcaccaaagggatcaaagtcacgattgttcagatccgtaatacctttaaagaggctattgttaggatctgtcttgataatcttatagcagttttgacagaggtcaatttgtttttgctttccattgagattggtataaagatgaatcgttgagtcattgattttacagttttgacaaagcatacatctacctcatttctttatttagcctgacctgtttaatggtcaaaaatagtcaaatttctatactctcattataacaggattggggtgtaaagcaagtaaaaagattgcagctttgagaagttgttacaatgaagaactttgtggatttggactataaaaaaatcctatttgtgagacaaaaaggattttggttagacatgcagggtgtaatcccagcttgttttgtattagtaaaggagttcgtaaatctccattgcaatcaagtcaatgctgtcaaacgtataagtttcgcgagcttcgacatcacgaagggtaaagattgagccgttttcttcgtcgtggctgtatgcaacttctgcaacaacaactcyttcgcgttcaaaattacgttttaaatttccaccgtcttttgtcattgcttcaaggcggttgatgattctaaccaaatgtgattccattttgattctccttcatttcttatcgttactattttaccataaaggaggtcaacttgcctagaaaaaactaagatttctcgctaattctactagcttaaaggttttttgaataaattagacaaaagatttgaattttaattcaatacatgttataatcatacagtattctattttagaaagcagtgtgactatgaatttttcttttttacctaagtatttaccttattttaactatggggctgtcgtgacggttctcatttctatctgtgttgtcttttttgggactattttgggtgttgtcttggcttttgggcaacgttcaaagtttaaaccgcttgtttggctcgccaacttgtacgtttggattttccgcgggacaccgatgatggttcagattatgattgcctttgcccttatgcacatcaatgctccgactattcaggttggaattttgggtgttgatctttctcgtctgattccagggattttgattatctctatgaacagtggtgcctatgtttctgagactgttcgtgctgggattaatgcggttccaaaaggtcagttagaggcggcctattctttagggattcgtcctaaaaacgctatgcgctatgtgattttgccacaagcaatcaaaaatatcttaccagcattggggaacgaatttatcactattatcaaggatagttccctcttatcagctattggtgttatggagttgtggaacggggctacaacagtttctacaacaacctatctacctttaacaccacttttatttgcagccttttactacttgattatgacctctattttgacagtagccttgaaagcttttgaaaaacgtatgggacaaggagataagaaataatgacagaaaccttgataaaaattgaaaatttacataaatcatttggaaagaatgaagtattgaagggcatcaacctcgagattaaaagaggagaagttgtcgttatcatcggtccttcagggagcgggaaatctaccttgcttcgctctatgaatttgttagaagaagcgaccaaagggaaggttatctttgagggagtcgatattacggacaagaagaatgacctctttgccatgcgtgagaagatgggcatggttttccaacaatttaacctctttcctaatatgactgtgatggaaaatatcaccttgtcacctatcaagactaaaggtgaaagcaaggcagttgctgagaagagagcccaagagttgttggaaaaagttggcttaccagataaggcagatgcttacccacagagtttgtcaggtggccagcaacaacgaattgctattgcgcgtgggttggccatggaaccggatgttttgctctttgacgagccaacttcagccctggaccctgaaatggtaggtgaggtgttggctgttatgcaagacttagccaagtcaggaatgaccatggttatcgtaacacatgaaatgggatttgctcgtgaggtggcagaccgtgtcatctttatggcagatggtgtggttgttgaagatggaacacctgaacagatttttgaacaaacccaagaacaacggactaaagacttcttgagtaaggttttataagttagttttgtggagctatttgtagctaactttacatataaagtatagattaatgaaaagctcgactagagctttttcttatagtttgaaactataggatagcctaggaaagaagtgttagaggggattagcagtttttggtataatggaagatatttgaaagaaaagagaagtgatatgacacagattattgatgggaaggctctagcagctaagttacaaggacagctggctgaaaagactaaaagattaaaggaagaaacggggctagtacctggtttggtagtgattttggttggggacaaccctgccagccaagtctacgttcgtaacaaggagaggtcagcccttgcggctggattccgtagtgaagttgtgcgagttccagataccattactcaagaggaattgttagacttgattgccaaatacaatcaagattcagcttggcatgggatattggtccagttaccattaccaaaacatattgatgaagaagcagttttgttggccattgacccagaaaaggatgtggatggtttccatcccttaaacatgggacgcctctggtctggtcatccagtcatgattccttctacgcctgcaggaattatagaaatgtttcatgaatatgggattgaattagaaggtaaaaatgcggttgttatcggtcgttccaatatcgttggaaaacccatggctcagcttcttgtggccaagaatgcaacagtgaccttgactcactcacggactcataatcttgccaaggtggctgctaaagcagatattctggttgttgcaatcggtcgtgccaagtttgtaactgctaactttgtcaaaccaggtgcggttgtcattgacgttgggatgaatcgcgatgaaaatggtaagctttgtggagatgtggattatgaagcggttgccccacttgctagccatatcacgccagtccctggaggtgtcggtcctatgaccattaccatgctgatggagcaaacttatcaggcagcgattcggacattggatagaaaataagagaaaaattttctgagaaaagtgtattttctatagctatatctaaaatggcagaaatgaatattaaattttagaaataagtttataaaaggaggtatgtgcctcctttttgttgtataatggagtgaggtgattagatgattttaaaaatttataatggggaatatagtttacaatgggatggaatatactacttagcactaattgattatccaaatattcaagagtgggaattagaaaaaattgctaaatttatagcttacgaaaaacttcataaacgtcaaacaagtattgagtgtgctgattcttgtttaaaaaaagaaattttagattacatctgtcagcatccctttctgccaccatttactcctacagataaaagagtagcctcgacttatgacctacataagaggttagtgacttcagactactgtagtcatactacgactatagatgcagcgatttctatttttaaaactggtcgtcttttatctgctgtgaaagcctttgggcgagatgctgaggagttggttttggatagtcgaaatgctgcatctgatccgatagattattttgactatgtcatgttagggtggtcaaatacaagttctggttatcgattggcgatggagcgtttattaggtcgagctccttcagagaaagaattacaagacaagtttattcctggagtaagttttcattttatctatacagatttgattaaagttcctggttatatttttgatggttaccatgctgtaaaaattaaggacatgcttaatttattaagtgagttgtatatttgcattattccaactcataataagagccaatttgaaaatattattccaaccaaaatacaagatagggtgtattatcttgactatgctggagaagacttagaagagtggactaagaaagtctatcaagttgttttaaaacaatcagataaaggatagttgaggaaaaacgatgagagtgattgagcaagcattattagaaaaagtcattattgaacgttctcgtacaagtcataaaggaaattacggtcgtctgctgttgctgggtgggacctatccttatggtggtgctattatcatggctgctttggcagctgtaaaaagcggtgcaggattggtgaccgttggaacggatagggaaaatatccctgctctgcacagccatttacctgaggctatggccttttctctgcaagaccagcaattgttacaagagcaattggagaaggcagaagttgtcttgctggggcctggtttacgagatgatgtttttggagaagatttagtaaaacaggtctttgctagcttaagacagaatcagattttgattgtagatggaggtgctttgactattcttgctaggacaagtttgtcatttccgtctaaccagcttatcctaactccccaccaaaaagaatgggaaaagctgtctggtattgctattgaaaatcaaagcgaagctgcaacggctagtgccctgacttccttccctcaaggaacgattttagttgaaaaaagttcagctactcgtatttggcaagttggccaatctgattattaccagttacaggttggtggtccctatcaggcgactgggggaatgggagatactctggctgggatgattgcaggatttgtaggccaatttcgacaggccagtctctacgaacgtgtggcagtagcaacccatcttcattcagccatagcccaagaactatctcaagaacattatgtggtcttgccgacggaaatcagtagtcatcttctcaaaataatgaaaaaaatatctcaaaaaggcacctgatcgtttcaggcgcctttatatttttagaaaaatcctttaatctttccaacgaggccatctagaccttcagaaccagaaattaactgctgagcttgggagaagtattctccaagctgttcttgattttctgcaacaaatgtttttgccgcttcgaaatcttttgtttcgattaattcttttacttggttaaacaaatctaatgggttcatcttatttctccttttctttacttaactatttaatcatctttatgataaaaaatcaactgttgctacttttggctaatattctaactaccaaaacaaggtggacataaaaataaaaatgttcggtttttttcagtgtatccatgaaataaaaagtgatacatgttataataaagttagctctttaatggaggtgtttgagtggaaaatctgaaaaaaatggcaggtatcaaggctgctgagtttgtcaaggatggaatggtagtcggactaggaacggggtctactgcctattattttgtagaagaaattggtcgtcggattaaggaagaagggttacagattacagctgtaacgacttctagtgtgactagtaaacaggctgaagggcttaatatcccgctcaagtctattgaccaagtagatgttgtcgatgtgacggttgatggagcggatgaagtggatagccggtttaacggaatcaaaggcggtggtggtgcccttctgatggagaaggttgtagcaacgccctcaaaagaatatatttgggtagtggatgaaagcaagctagtcgagaaactgggtgcttttaaattgccagtagaagtggttcagtatggcgcagaacaggtctttcgtcgttttgaacgagctggctacaaaccaagtttccgtgaaaaagatggccaacgttttgtgaccgatatgcagaactttatcattgaccttgccttggatgtcattgaagatccaattgccttcgggcaagaattggaccatatcgttggtgttgtagagcacggcttattcaaccaaatggtggataaggtcatcgttgctggacgagatggggttcagattttaacttcaacaaaagcaaactaatcaacataataaggagacacattatgtcaaaatttaatcgtattcacttggtggtactagattctgtaggaatcggtgctgcaccagatgccaataactttgtcaatgcaggggttccagatggagcttctgacacattaggacacatttcaaaagcagttggtttgaatgtcccaaacatggctaaaattggtcttggaaatattcctcgagaaactcctcttaagactgttccagctgaaagcaatccaacaggatatgcaacaaaattggaagaagtatctcttggtaaggataccatgactggacactgggaaatcatgggccttaacattacagaacctttcgatactttctggaatggattcccagaagaaatcttgacaaaaattgaagaattctcaggacgcaaggtcattcgtgaagctaacaaaccttactcaggtacagccgttatcgatgactttggaccacgccagatggaaactggggagttgattatctatacttcagctgaccctgttttgcaaattgctgcccacgaagacatcattcctctggatgaattgtatcgtatctgtgaatacgctcgttcgattacccttgagcgcccagcccttctaggtcgcatcattgcccgtccttatgtaggtgaaccaggtaacttcactcgtacagcaaatcgtcgtgacttggccgtatctccatttgcaccaactgttttggataaactcaatgaagctggtatcgatacttatgctgttggtaaaatcaatgatatctttaacggtgcgggtatcaaccatgatatgggacacaataagtcaaatagccacggaattgatacactcttgaagaccatgggccttgctgagtttgaaaaaggattctccttcacaaacttggtggactttgatgccctttacggccaccgtcgtaatgctcacggctaccgtgattgcttgcatgagtttgatgaacgcttacctgaaattatcgcagccatgagagagaacgaccttctcttgattactgcggaccatggaaatgacccaacgtatgcaggaacagaccacactcgtgaatatattccattgttggcctacagccctgcctttaaagggaacggtttgctaccagtcggacattttgcagatatctcagcgacagttgcggataactttggtgttgaaactgccatgattggggaaagtttcttaggtaaattggtataagatgacgcgatatgctttacttgttcggggcattaatgtcggtgggaagaataaggttgtcatggcgcaacttcgtcaagaattgacagagttgggactgggaaaggttgaaacctacatcaacagtggcaatattttctttacttcgacagatcccaaagcccaattggttgaaaagttagagtctttctttgaaatccattatccatttattcagagcttttctttgctgagtcaggaagattatgaagaagagctgaataatctgccagattggtggatcaaagatttggcacgaaaggatttcctcttttacactgagggattggatgttgttcaagtcattgagacagttgaaagtttggaattgaaagatgaaatcgttcattttggaagacttgggattttctgggggaaattctctgaggaatcctactatgcaactgcctatcacaaatacttactcaagatgcctttttatcgcaacatcaccattcgtaatgctaaaactttcgacaaaatcggtcaaatgctaaaaaataataaaggagacatacaatgacatttttagataaaatcaatgaaactgctgccttcctgaaagaaaagggtatcctagcgcctgagttcggtctaatccttggatcaggacttggagaattggcagaagaaatcgaaaatccagttgtagtagattatgcagatatcccaaactggggccgttctacagtagtcggacacgctgggaaattggtatatggagaacttgcaggtcgtaaggtcttggctcttcaaggtcgtttccatttctacgaaggcaatcctcttgaggtcgtgactttcccagttcgtgtgatgaaagtactcggatgtgaaggtgtcattgtaaccaatgcagctggcggtattggatatgggcctggtactttgatggctatctcagaccatatcaacatgacaggtcaaaacccattgatgggtgaaaacttggatgaatttggtcctcgtttcccagatatgtctaaagcctacacaccagaatatcgtgctactgcccatgaagtggctaaaaaacttggtatcaagcttgacgaaggtgtctatattggtgttactggtccaacttatgaaacaccagcagaaatccgtgcttataagacactgggagcagatgcggttggtatgtctactgttcctgaagttattgtggcagcccactcaggcttgaaagttctaggaatttcatgtattactaactttgcagctggattccaagaagaactcaaccacgaagaagttgtagaagtgactgaacgtgttaaaggcgacttcaaaggtttgcttaaagcgattcttgcagaattgtaatcatgttaatagaattgaggagtatttttcgaaaaatcccttataattttagatttttcctagcagtaattctgcaaggaatagtttcgggtttatctggtatttttctccattatctattagagatggtggaggagctagcttttggtcagtcagagcatcatagtggatttttgacagatggagtttcctcttcacggataggactaagtttaatgatggtgggtcttggctcatccttggtctggtatttcttgcaaaaagggtcgaagatttattccatcaaagctcagatgaaggatgagacttcacaatacaagcttcattttctaaaacagctatttcattcaatttggcagatcattgcagttggagggggagcgcctattggcaaagaagctgcgccacgagagattggaactctatttgcaggaccaattggaaaaatatgttctctctctaagaaggatcgcatctttctccttgcttgtggtgctggtgctggtttagcggctgtttatcaggttccattaacaagtgtcttctttgtttttgaaaccttaggaattgatctatctattaaacgatttgtcttagtcggtttgactacctatgtctcaacctatatagcaggctgggttatttcagatcaggctctctaccagattccagccatcacatggtcattaaagcaaatatggattattcccttattacttcttttcttaaccccactagcttggctttttggtcgcttaagtaaggcagcgtcttcaaaaaggataaaagataaacgaatacttctaacattgtcctcagcttttctttttcttattggattagcaagttattttccacatctacttggaaatggacgtatgatgtctcaggaagtattgaattgtagcaatggcaaaacagtattcctcttatttatcctaaaagcactggtcgttcttattactctgtgggcaggggcctatggtggtacacttacgccatcttttgccttggggatggctggagctgctctctttggaatgattctaggtggagatagccagccaagcattttacttttgggatcggtttgctttttgtctgtgaccttgagggcgcccatttctgcaaccggattagttataggtttcactgggctaggtatagattctcttccgtatctcttagtaacagctgttttagcctatgaacttgcaaaaatgctagaccgctttccttggactagcatactgtgtcagaagtcaaagagtaaagtaattaggtaggaaatgcccatttcttctagtcaatgatttgatttaaaagattaaaaaaactctcaatttatttataactgttttaaataaaaatgtagtaggcctattggaatcttgattgaatccgatttttcctagctatgaaatataaaaataaaaaaagaaaggtagagcgcgtgttctaatttgaacacgaacggaaaacttttctaaaaattcagaagagaaggggagttctgctttgaattgaagccggtctaatcttctcaatatcatcaaaattaagaaagaaaggaattgaacccaccctaaaagcagtgggaaaaagatagttggtctagcgagcatcgctcactgcacccaactcctattttccctttgttttttgacgggtttggtatcttatattatgtctatccatattgctgctcagcagggtgaaattgctgataaaattcttcttcctggggatcctcttcgtgctaagtttattgcggagaatttccttgaagatgctatttgttttaacgaagtgcgtaacatgtttggttatactggtacttacaagggccaccgtgtctctgtcatgggaactgggatgggaatgccatcgatttcgatttatgcgcgtgagttgattgttgactacggtgtgaaaaaattgatccgtgtgggaacagcaggttcattgaatgaagatgttcacgtccgtgaattggttttggcgcaagcagctgcaaccaactctaacatcatccgcaatgactggccacagtacgatttcccgcaaatcgctagctttgatttgctggacaaggcctaccatatcgccaaagaacttggtatgaccacccacgttgggaacgttttgtcttctgatgtcttttactcaaactactttgaaaagaatatcgagcttggtaaatggggagtcaaggctgtggaaatggaagcagcagctctctactatttggctgcccaacatcacgttgatgcccttgctatcatgactatctctgatagtttggtcaatccagatgaagacacgactgcagaagaacgccaaaataccttcacagatatgatgaaggttggattagaaaccttgattgcagagtaattatatctaaaaaaggaagcccttctttatgaattggaggacttccttttcttatctagaaattgatctagctctctttgatttcgaagaatagtgactttatgtgagtattcttggcaaagtttttggtaattttttctttgagctttagttcgtccatcccagagaatccatcgaataaactcccaattaaattgttctcgacaaccttctgccatactttctctgaccttgccccgatatgtaatgtaacgcttaaatgctcgaaagagacaggtcaatggagaaaaattaagaaagatgatttggtcagcttcctgcattctttcttcgtaatagcaccaagaataattaccatcgataacccaagattcattctttgtgagaaagtttttcatctcggtcaacatccatccgcggtcactgtcttgccaaccaggttgaaattggagtgtgtccatgtgaagttttgggatggagtagtagtgagacaacttttctgctagagttgacttaccagcaccagaatatccgataattgcaattttcattttctaccttttcctatttgaggacaaaaaaacagcctctatggactgtttcttatttagcaagtttagctgaaagacgagctttgtcgcggcttgctttgtttttgtgaatcaaacctttagtttctgctttatcgatagctgagctagcagcacggaaaagttcttcagatgggtttgcttcgaaagctttgatagcagtacgcatagctgatttttgagctgagttcttttcgttttgtttaacgttcaattcagcgcgtttgatagctgatttaatgtttgccaatgttcttacctccatatttactaactataccattatatctgaaaacttacgttttgacaagggaaaattacttttttaagtaaatttcatcgatttcatggttctttgttttatgcagaatcacttccgcacggtttctggttggttcaatataattttgtagatttgtgagattgatactggtccagacctgatgggcaaaggattccacttccccaatcggcatttgtgtaaaacgataatagtagctatcaggatcgttttgggctaggctcagcattttcaagaaacggtccagataccaactctcgatgtcatcgactgcagcatcgacatagatggaaaagtcaaagaagtcagtaatgtagagacgctcgttttgtggattttgaaagacatttattccttcaacaatgacaaaatcagcagctttgacgctttgcttttcctcgggtacgatgtcgtagacttcatgagaatagacaggaatatctacatcttgtccatttttgatgtgatccaggaagttgagaagagcttccatatcatagctttcaggaaatcccttgcgatttaaaatcccttgttcaatcaagatctggttgggatagagaaagccgtcagttgttaccaactcaaccctagcatctgtaagggtacgggacagtaggatttgaagtaggcgactggttgtggattttccaacggcaacactcccagaaaccccaatgataaaaggctgggatttactttcacgttgaaggaaaatcccttttgaaaaggccaaatcatccttggtacgcttgtaaatctggatgagatgggctagggggagatagacatcggtaacatcctgcaagctaatctggtcattaaaactcttgatggattctaattcctcttctgtcaaaggaggtgtggtttttctatgtaacgattgccaagtctggcggctgattttttcaaaatgtaaaaattcgttggtcatttgttttcccctagatattttgtttatcataccataaaaagctaaaaaaataaagcggtttcttgatgatagtaaaccaatatcgtataatagaagtagatagggttgaccaatttattgatgaggtaggagctactttctcctgacttataagccaataaagggggctttgggattcacaatttataggaggtgtactatgaaaatcttaaaaagttatatactggaactctgttttattttaagttttgcactaccttttataaaaggggcgaatgcggataatggtagacgctttgtggaaatctattacggttttacttttttgatggaacatgctattgtaacagctatctttatctgttcgctcttgattgcttgcctactaaaaaaacggtggacgaaatggcttgctgctggtagttatttctttttagttctatggattgctacagagggttatttcttccgcatgtcgctagaagatttggtacgactttggacaagttgggaaatcctgacaaaaacgtatcagttgggcttttatctaaacatcctgttgggaattttgttgataattaagtatctgaaggttaagcaatagtaataagaatgcgcctaattatagatgataaacattttgttatatcctaattatgatatttctagttctaaatggcttattatttataagtgtttaaagagattgaagaaaatgttttacttactagctttcttcagtctttttcgttttattatcaatttgtaaacgatttacaatttaagtcaaattatggtaaaatagtttcatgagtaaaatgtattatgcagaaaatcctgacgctgctcacgacattcatgagttgagagtggacttattgggagaaaaaatgacctttttgacggatgcgggtgtttttagcaagaaaatggttgactttgggcagtcaactcttgctcaagtgtctagaggtcaaccaaggagagactgtccttgatgtagggtgtggttatgggcctttgggcttatccttggctaaggcttatggggttcaggcgaccatggttgatatcaataatcgtgccttggatttggcgcgacaaaatgctgaacgaaataaagtagaagcgacgattttccagtccaacatctatgaacaagttgaaggcacatttgaccatgtcatttcaaatcctcctatccgtgcgggcaagcaagtggttcatgaaatcattgagaaaagtaaagatttcttggaaactggtggagatttaacaatcgttatccagaaaaaacaaggggctccaagcgccaagtcaaagatggaggaagtgtttggcaattgtgaaatcgtcaaaaaagataagggatattatatccttagaagtgtgaaagaatgagagcagttgatttaatccaaaaaaaacgagatggtcaagaactgacttcgagtgaaattgaatggctagttgaaggctatgtgtcaggaactgtccctgattatcagatgtctgcctttgctatggctgtttatttcaaaggaatgacgactcgagaaatatctgatttgaccatgaaaatggttcagacagggcaagagtttgatttatcagctattgatggggttaaggttgacaagcattctacgggtggtgttggtgacaaggtgaccttgattttagctcctttagtagcgagttttggagttccagtcgcgaaaatgagtggtcgtggtctcggccatacgggtggaacgattgataaattagaatcaatcaagggctatcaagtagaacgtagtcaagaggatttcattcatcaagttcaggatattggtgtatctgtcattgggcaatcagaccagcttgtcaaagcagataagcttctctatgcccttcgtgatgtgaccgcaactgttgacacgattcctttgattgccagttctgtcatgagcaagaaaattgcagcaggggcggatgctattttgctagacgtgactgtcggtgagggggccttcatgaagacggttgatgaggcgcgtgaattggctcaaaccatggtggaacttggtaaggcagttggtagaaaaacggtagcagtcattacggatatgagccagcccttgggacgagcgattggaaatcgcctcgaaattcttgaagcactggagattttacaaggtcaaggccgtcaggatattacccattttatatgcgaattggctcaaattatgcttggcctggcaaatgttaacaagacagttgaagaagttcgccaacatcttgagaatggtaaggcactggctaagtttgaggagatggtccaagcccaaggtggagacttggaagacctctatcgtcctgtaaatgttgcccatgtggtggaaatccctgctcaggaaacgggtgtcatttcagctcttccagctatggaatttgggctttatgctatgagactgggggcaggccgtgcagttaagtctgatgccttggactatgaaacaggaattgtttttgaaaagaaagttggagattccgttcaaaagggagaaattgttgcaaaagtatatacaaatggaaaaatttcttctcagctagttacagattttcaaaaatatgttaaaataaatgatagtgtgcaaagtttacgagaaattatagaaatcatctcataaactgcaggagaatccgaatatgaaattaaataaatatatcgatcatacacttttgaaacaagatgcgacagtaaatcaaattgattgtttgttgtctgaagctagagagtatgattttgccagtgtttgcgttaatccgacctgggttgaacatgctaaaaaagggcttgaaggcacagatgtcaaggtctgcacagtagttggtttccccttgggagcaacaacttcagccgtgaaatcatttgaaaccaaggaagctatccaaaatggtgcagatgagattgatatggtgattaatgttggagctctcaaaacaggtaatcttgatttggttgagtcggatattcgcgcagtagtagaagcaagtggtgacaagttagtgaaagtcattattgaagcttgccttctgacagaccaagaaaaagttgtggcttgccaattagcccaaaaagcaggagctgattttgttaaaacatctactggcttttcaactggtggtgcgacagtagcagatgttagattaatgcgtgaaacagttggacctgatatgggagtcaaggctgcaggtggagctcgttcttatgcagatgctcttgcctttgtggaagcaggggcgacccgtatcggaacgtcagctggggtagccattttaaaaggagaattggctgatggcgactactgagttgattgaactagcaattgaaaccagcaagaaagcctatgtgccctattctcactttcctatcggagcagttttagtggcgaaagatggtagctcttatacaggtgtcaatattgagaatgctagttattctttgactaactgtggagaacgtacagcgatttttaaagcagtttctgaaggccaaagagaattttcagaattgattgtctatggtcagactgaaaaaccaatttcgccatgtggtgcttgtcgccaagtgatggctgaattttttgaacaagatctaaaagtgaccttagtcgcaaaagataaatcgacggtcgagatgacggtcggggagttacttccatactcttttacagacttaaactagtctgagtcgctctctgagtggcacggtccttgtggccaaccaatccatacttgcaacatcgttgcacatcttatttaggaggttcagtaatgaacaagaaacaatggctaggccttggtctagttgcagtggcagcagttggacttgctgcatgtggtaaccgctcttctcgtaacgcagcttcatcttctgacgtgaagacaaaagcagcaatcgtcactgatactggtggtgttgatgacaaatcattcaaccaatcagcttgggaaggtttgcaagactggggtaaagaacataatctttcaaaagataaaggtttcacttacttccaatcaacaagtgaagctgactatgctaacaacttgcaacaagcggctggaagttacaacctaatcttcggtgttggttttgcccttcacaatgcggttgaagaagcagcaaaagaccactctgatttgaactatgtcttgattgatgatgtgattaaagatcaaaagaatgttgctagcgtaacgtttgctgataacgaagctgcttaccttgcaggtgttgcagcagccaaaacaacaaaaacaaaacaagttggttttgtaggtggtattgagtctgaagttatctcacgttttgcagctggatttaaagctggtgttgagtcagtagatccatctatcaaagtacaagttgactatgctggttcatttggtgatgctgctaaaggtaaaacaattgcagcagcacaatacgcagctggtgcagacgttgtttatcaagcagcaggtggaacaggtgctggtgtctttgcagaagcaaaatcactcaatgaaagccgttctgaaagtgaaaaagtttgggttatcggtgttgatcgtgaccaagtagcagaaggtaagtacacttctaaagatggcaaagaatcaaacttcgttcttgtatctactttgaaacaagttggtacaactgtaaaagatattgctaacaaagcagaaaaaggtgaattccctggcggtcaagtgatcgtttactcattgaaagataaaggggttgacttggcagtaacaaacctttcagaagaaggtaaaaaagctgtcgaagatgctaaagctaaaatccttgatggaagcgtaaaagttcctgaaaaataatggatggaagtcatttcttaggaagcggccctcggccgcttttttaagagttgagacaaagtcattttgtctcagtaaagcttgctactagataaactagcaagttttattgaaataaaataagactctgaaaggaagagcacatggcacaagaaaatgtcattgagatgcgtgatattaccaaggtgtttggtgaatttgttgccaacgacaaaatcaacctgcacctacgaaaaggtgaaattcatgcacttttaggagaaaatggggctggaaagtccacgctaatgaacatgttagcagggcttcttgaaccaaccagtggtgaaattgtggtcaacggtcaagttgtcaacctcgactcaccatctaaagcagctagcttgggaatcggaatggttcaccagcactttatgttggtagaagccttcacagtggctgaaaacatcattttaggtagtgaattgactaaaaatggtgtgctagatatcactggagctagcaaagaaatcaaggctctttctgaacgttacggcttagctgttgatccttctgctaaggtggctgatatctcagttggagcccaacaacgtgtagaaattttaaaaaccctttatcggggagctgatatccttatctttgacgaaccaacggctgtcttgactccatcagaaattgatgagttaatggctattatgaaaaatcttgtcaaagaagggaaatcaattatcttgattacccacaagttggatgagattcgtgcagtttctgaccgcgttacagttattcgtcgtgggaaatcaattgaaaccgtcgaaattgcaggagctaccaatgctgatttggcagaaatgatggtaggtcgttctgtttcctttaaaacagagaagcaagcttctcaaccaaaagaagtggtcttgtcaatcaaagatttggtggtcaatgaaaaccgcggtgttccagctgttaaaaatctgtccttagatgttcgtgctggagagattgttgggattgcggggattgatggaaatggtcagtctgaactcattcaagccattacaggtcttcgcaaggttgaatctggtagcattgagctaaaaggagattcaattgtaggcttgcacccacgacaaattacagagttgagtgttgggcacgttccagaagaccgtcaccgtgatggcttgattttggaaatgatgatttctgaaaatattgcccttcaaacctactacaaagaaccacatagtaaaaatggaattttgaactattcaaatattacttcttatgctaaaaagttaatggaagagtttgatgttcgcgctgccagtgaatttgttcctgcagctgcactctcaggaggaaatcaacaaaaagcaattattgctcgtgaaattgatcgagatcctgatctccttatcgtcagccaaccaactcgtggtttggatgtcggtgccattgaatatatccacaaacgcttgattgaagagcgtgataacgggaaggctgtccttgttgtcagctttgaattggatgagattttaaacgtttcagaccgtattgccgttatccacgatggtaagattcaaggtattgtatcaccagaaacaaccaataaacaagaacttggtgtcttgatggctggtggaaacttgggaaaggagaagagtgatgtctaaaaaattacaacaaatttcggttcccttgatttctgtattcctaggaattttactcggagccattgtcatgtggatctttggttatgatgctatttggggctatgaagaattgttctatacagcctttggtagcctgcgtggaattggagaaatcttccgtgctatggggccattggtcttgattggtcttggttttgccgttgccagtcgagcaggtttctttaacgtcgggcttcctggtcaggctttggcgggttggattctcagtggttggtttgccctgtcgcatccagatatgccgcgtcccttgatgattctagcaaccatcgcgattgccttgattgctggtggaattgtcggcgcgattccgggtattctgagagcctatctagggacgtcagaggtcattgtgaccatcatgatgaactacattgtattgtatgtaggaaatgcctttatccatgccttccctaaagactttatgcaaagtacagattcgaccattcgtgttggggctaatgcaacctatcagacaccttggttgtctgagttgactggtaattcgcggatgaatattggtattttctttgccatcattgccgttgcagttatttggttcatgctcaagaaaacaactcttggttttgaaatccgtgcggttggtctgaatccacatgcttcagaatatgctggtatttctgcaaaaagaacgattatcctctcaatgattatctcaggtgccttggcaggtcttggtggagctgttgaaggtctgggaaccttccagaacgtttatgttcagggggcgtcattagctgtcggatttaacggaatggcggttagtctgcttgcggccaactcaccaattggtattctatttgcagccttcttatttggtgttctccaagttggagcccctggtatgaatgcggcgcaggtaccgtctgagcttgtcagcattgtaacagcgtctattatcttctttgtcagtgttcattaccttatcgaacgctttgtcaaaccgaaaaaacaagttaaaggaggtaagtaaagatgtctattacaacattgctcaccctcttggtatcttctatgctgatttactcagcacccctcatctttacaagtataggtggtgttttctctgaacgtggtggtgtggtaaacgtcggtcttgaaggaattatggttatgggtgccttttctggagttgtctttaaccttgaatttgcagaacaatttggagcagcaactccttggttatccttgctagttgcaggattggttggtggtgtcttctctatcatacacgcagcagcgacggttcatttccgtgcagaccatgttgtcagcggtacggtattgaacttgatggccccagccttggctgttttcttggtgaaagtactttataacaaaggacaaaccgacaacctaagtcagacttttggacgctttgatttcccattcttggcaaatatcccagtgattggtgatatcttcttcaagtcaactagtctacttggttatctggccattgccttctctttccttgcttggtttatcctcttcaagactcgatttggtcttcgtctccgctctgtcggtgaacatcctcaagcagcagatactttgggaatcaatgtctacaaaatgagatatttaggggttattatttcaggtttcctaggtggaattggcggagcgatttatgctcaatccatctcagttaacttctcagtgacaactattgttggacctggatttatcgctcttgctgcgatgattttcggaaaatggaatccaatcggagccatgctttctagtttattctttgggctttcacaaagtttggctgttatcggttctcaattgccgttcctacaaggagtgcctgcggtttatcttcaaatcgcaccttatgttttgacaattcttgtcttggcagccttctttggaaaagcagtcgcaccaaaagcagatggtatcaactatatcaaatcaaaataagcatacaaaaaacgtcagttcagaatgaactggcgttttattttttaggatgttgattggttaggttcaatccccaagggactaaattttcagtcttgtttttgatacgagcgacattatccttatgacgaatgataatcaaactagcaagtgctaggataatagcaatgaagagagggtcatagtgactcaagataaaaccaaaaagtggaaagagtaaaactccaatgacagccgcgatagatgctgtgacactagatagtgaaatcatactaccaagatagagggttccaaagaaaacaactgcaaggtagagacagaagacaggtgcaaatccgaaaaccactccagcactggttgcgacagccttgcctcccttaaatcctgcaaagatagggaaggtatgtccaatgacagccaaaagtccaaagatgagaggcgaaactccttgaagatgaaacataatcggaagcagtgttgctagggttcctttgaaaaagtcaatcacaaaggttgccataccagctttcttgcctaaaatgcggaaggtattggtcgttccagtgttaccagaaccatgctcgcgcagattgatttgaaagaatacttgtccaatccagagaccagacggaatcgaacccagcagataagctaggattaataaaactattgtaatcatactcctattatatcatgaaatggagaagaaaggcagagaatctcttctgaaattgtcacaccggagaaagaaaaattttgcaaaatccttggaaaacctgtagaatagtaaagatgaacgaataggaggttccttgtgtcaaaaaaggaaatcaatattaacaattataatgatgatgccattcaggtgctagaagggttggatgcggtccgaaaacgtccagggatgtatatcggatcgaccgatggcgctgggctccaccacctagtctgggaaatcgtcgataatgctgtcgatgaagccttgtctggatttggtgaccgtattgatgtgaccattaataaagacggcagtttaacggttcaagaccacggacgtgggatgccgactggaatgcacgctatgggaatcccaacagttgaggttatctttaccattcttcacgccggagggaaattcggtcagggtggctacaagacatctggtggtctccacggggtgggttcttccgttgttaacgctctttcaagttggctagaagttgaaatcactcgcgatggtgcaatctacaagcaacgttttgaaaatggtggaaaacctgtcacgactctgaagaaaatcggtacagcacccaagtctaaaacaggtaccaaggttacttttatgcctgatgcgacgatcttctctacgacagatttcaagtacaataccatctcagagcgtcttaatgaatcagcctttctcttgaaaaatgtgaccttgtccttgacggacgagcgaacagatgaagcgatcgagtttcactatgaaaatggggtgcaggactttgtttcttatcttaacgaagacaaggagaccttaacgccagttctttactttgaaggagaagataatggtttccaagtggaagtggctctccagtacaatgatggattttcagataacattctatcctttgttaataacgttcgtactaaagacggtggaacgcatgagacaggactcaagtctgctatcactaaggtcatgaatgactatgcgcgtaagacaggtcttctcaaggaaaaagataaaaaccttgaagggtcagactatcgtgagggactagcggccgttctttctatcttggttccagaagaacacctccagtttgaaggccagaccaaggacaaactaggaagtccacttgctcgtccggttgtggatggcattgtggcggataagttgaccttcttccttatggaaaatggggaattggcttctaatctcattcgcaaggctatcaaggcccgtgacgctcgtgaagcggcacgtaaggcgcgtgatgagagccgaaatggtaagaaaaataaaaaagacaagggcctgttgtcagggaaattaacacctgcccagtccaagaatccagctaagaatgaactctatctagtcgagggggattctgccggtggttctgccaagcaaggtcgtgaccgcaagttccaagctatcttgcctcttcgtggtaaggttatcaacacagccaaggccaagatggcggatatccttaaaaatgaggaaatcaacaccatgatttataccattggtgcgggtgtcggagcagacttctcccttgaagatgccaactatgacaagatcattatcatgaccgatgcggatacagacggtgcccacattcagactttactcttgacatttttctaccgctacatgcgtccgctagttgaggcgggacatgtctatattgcccttccgcctctttacaagatgtccaaaggaaaaggcaagaaagaagaagtggcctacgcttggacagacggagaacttgaagaactccgcaagcagctcggtaaaggcgctaccctccaacgctataaagggcttggtgagatgaatgcggaccagctctgggaaacaaccatgaatccagaaacccgtacccttatccgtgtcaccattgaagatctggctcgcgccgaacgtcgcgtcaatgtccttatgggagacaaggtcgaaccacgacgtaagtggattgaagataatgtcaagtttacgctggaagaagcgacagtattttaagttagtttttaatgaatgggtataaacatgagaactgaaacagaaatgctcgatgtagttttaaagactgctgaaaccttacaagtcacggctgtcgccatgtctggttcacggactgatacaaaagcctcaaaagatgaatttcaagactatgacgtagtctatgttgtagagaatctggacgagctgattacagatttatcttggttggaccagtttggcaaacgcattatcgagcaagaagttggtcttggtcaacgtcgtctatacctcatgctctttgaagatggaaatcgaattgatctaaccctctgtccaaaacaacaaattcaagagtgggtggatagtgaggccggatttactgttttagaagatccagagcatttatttgaaccctattcaccaaatatagagcgttactggacgaatccagctagtcagacagattttgaaaaagcctgcaatgagttctggtgggtgtcggcctacgttgtcaaagggatttgtcggaatcagctcatctacgcgaccgatcatctctatggcatttgtcaacaagaactcctgaaaatcttggcttggcaggtagcaagtgctaggggaagagtcgaaatcggcaagaactgcaagtatctctttaaccatttgccagttgaaaaagagaaggagctatctaatcttcttgatttttccagtttagacaaaatcactcagtctctatttgatacgatgcaacttttccaccaagaggctcagtcccttgctcaaaagatgggttttgactacgataaagaagtagctgaggagatgattcaatacgctgaggagagacttcttaattgctgactaatttaaaagattaaactacagaaaggattgtttggttccttaaggtaactgaacatgggactaattcccgtaaaatatcttttactgcataaaaacctactctacattctttgaaaggagttgaacacgccctaaatgctgggtgaaaaagataaattctcttgtgagcttgcttacttcaataattttctattttcacttggtattttacgggctctgtatcctatatgagtaacattcaaaacatgtcccttgaggacatcatgggagagcgctttggtcgctactccaagtacattattcaagaccgggctttgccagatattcgtgatggcttgaagccggttcagcgtcgcattctttattctatgaataaggatggcaatacctttgataagagttaccgcaagtcggccaagtctgtcggtaacatcatggggaatttccacccacacggtgacagttctatctatgatgccatggttcgtatgtcacaggactggaaaaatcgtgagattttggttgaaatgcacggtaataacggttctatggacggagatccacctgcggctatgcgttataccgaggctcgcttgtctgaaattgctggttatcttcttcaggatatcgataaaaagaccgttcctttttcttggaactttgacgataccgagaaagaacctactgtcttgccagcagcctttccaaacctcttggtcaatggttcgactgggatttcggccggttatgccacagacattcctccccataatttggctgaggtcattgatgctgcagtttacatgattgaccacccaacagccaaggtggataaactcatggaattcttgcctggaccagacttcccgactggagggattatccagggtcgtgatgaaatcaagaaggcctatgaaactgggaaagggcgcgttgttgttcgttccaagactgagattgaaaagctaaaaggtggtaaggaacaaattgttattactgagattccttatgaaatcaacaaggccaatctagtcaagaagattgatgatgttcgtgtcaatagtaaggtggcaggtattgctgaggttcgcgatgagtctgaccgtgacggtcttcgtatcgctattgaacttaagaaagacgctaatacagagctcgttctcaactatctatttaaatatactgacctgcaaatcaactacaactttaacatggtggcgattgacaatttcacacctcgtcaggtcggtattgtcccaatcttgtctagctatattgcccaccgtcgtgaagtgattttggcgcgttcacgctttgataaggaaaaggctgaaaaacgtctccatatcgtcgaaggtttgattcgtgtgatttcaatcttggacgaagtcattgcgcttatccgtgcttctgagaataaggcggatgccaaggaaaatctcaaagttagctatgattttacagaggagcaggctgaggccatcgttaccttgcaattgtatcgtttgaccaataccgatgtggttgtcttacaggaagaagaagcagaacttcgtgaaaagattgccatgctggcggctattatcggggatgagcggactatgtacaatctcatgaagaaagaacttcgtgaggttaagaagaagtttgcgactccgcgtttgagttctctagaagacactgcgaaagcaattgagattgatacagccagtcttatcgccgaggaagatacctacgtcagcgtgaccaaggcaggttatatcaagcgtaccagcccacgttcctttgcggcttcaacgctggaagaaattggcaaacgtgatgacgaccgtttgatttttgttcaatctgccaagacaacccagcatctcttgatgttcacgacgcttggaaatgtcatttatcgaccaatccatgaattggcagacattcgttggaaggatatcggtgagcatctgagccaaaccattacaaactttgaaactaacgaagaaatcctttatgtggaagtagtggatcagtttgatgatgcgacaacctactttgctgcgactcgtctcggtcaaatcaagcgtgtagagcgaaaagaattcaccccatggcggacctacaagtctaagtctgtcaagtatgctaagctcaaagatgatacagaccagattgtagcagtagctccaatcaaactagatgatgttctcttgatcagccaaaatggttatgcccttcgtttcaatatcgaagaggtaccagttgtcggtgctaaggctgcaggtgtcaaggctatgaacctgaaagaagatgataccctccaatcggcctttatctgtaacacttcatccttctacctcttgactcagcgtggaagtttgaaacgtgtttctattgacgaaattccagcaactagccgtgccaaacgaggactacaagtcttgcgtgagttgaaaaacaaaccgcatcgtgtcttcttagcaggatcagttgcagagcaaggatttgttggtgatctcttcagtacagaagtggaagagaacgaccaaacgctgcttgtccaatcgaacaaaggaacaatctatgaaagtcgactacaagacttgaatctgtcagaacgcacaagtaatggtagcttcatctctgacacgatttcggatgaagaagtttttgacgcttatcttaaagaagtatttactgaagctaaataagtgaaatgaagaatcagttctaagagctggttctttttattgaagaaattttctgaaaattacaaaatatacttgctattttagaaaaatagtgtagaataaaagaaataggtttttagaataaggagtggaatatgacagtaacgattgattgggaaaatctcggtttttcctatatgaaattaccttatcgctatattgctcattttaaaaatggacaatgggatcaaggagagcttacagaggatgcaaacttgcatatttcagagtcttctccaagtcttcactatggtcaacaagcatttgaaggtttgaaagcttatcgtactaaggatggtagtgttcaactgttccgtcctgatgaaaatgctaaacgcctgcaacggacatgtgaccgtctcttgatgccacaagttccaacagaaatgtttgtagacgcttgtaaggcagttgttcgtgcgaatgaagaatatgtacctccatatggaacaggtggaaccttatatcttcgccctcttttgattggtgtcggagatattattggggttaaaccggcagaagagtacattttcaccatctttgctatgccagttggaaattactttaagggtggattggttccaaccaacttcttgattcaggatgaatacgaccgtgcggctccaaatggtacaggtgcggctaaggttggtggaaactatgctgcaagtctcttgccagggaaattggccaagtcacgtcatttctcagatgttatctatctagacccatcaactcatacaaagattgaagaagtcggctcagctaacttctttggaattacagctgataatgaatttgtaacaccattgagtccttctatcttgccatctattaccaagtattctttgctttatttggcagaacatcgcttgggcttaactcctattgagggggatgtcccaattgataaccttgaccgttttgtagaggcaggtgcctgtggtacagcagcagttatttctccaattggtggaattcagcacggtgatgatttccatgtgttctatagcgaaacagaagtaggtcctgtgactcgtaaattatatgatgaattgacaggaattcagtttggcgatattgaagcgccagaaggttggattgtaaaagtagattaaaataaactaaaggagattttttatgaaatcgaaaaagtggctcttaacagcaggagtggtcctgagcacaacagctcttttagtagcttgtggaaaagctgataaagaagcagatgcaccgacaacattttcatatgtctatgcagtagatccagcatctttggactatagtatagcgactcgtacatctacaacagatgtcatcgggaacgtggttgatggtttgatggaaaatgaccaatacggaaatgttattccttccttggctgaagattggtctgtgtcaaaagatggtttgacttatacctacaaacttcgtaaaggagttaaatggtacacttctgaaggtgaagaatatgcagaagtaacagcccatgactttgtgacaggactaaaacacgtagctgacggtaagtcagacggtgtctctctcatccaaaattcaatcaagggcttggatgcctacatgactggtgagaccaatgatttctctacagttggtgttaaggccttggacgattatacagttgaatataccctaaacaaaccagaaagcttctggaactctaaagtcaccacagcaacgatgttgcctgtaaatgaagagtttttgaaggcatcaggtaaagattatggagcagttactccagcagggattctttacaatggtccttatatcttgaagaccttgacttctaaatcgttgatcgaatacgagaaaaacccaaattactgggataaagaaaaggtaaaaattgaaaaggtcaaattgacttactacgatggttctgatcaggaatcgttgattcgtagcttctcttcaggtgcctatacgacagcccgtctcttcccaagtagctcaaactttgcttcaactttggaacaatacggagataaaatcacttatagcccacaggactcaagtagttattacttcacctttaacgtaaatcgtcaatcatataataaaactgcgaaaacaagtgaagagcaaaagacttctactaaagaagctatgcttaataaggacttccgtcaggctatcaactttgccttcaaccgccattcttatgctgcccagctaaatggtgaagacggtgcggacaagattattcgtaacagcctcgttcctgacaactttgtacaagcaggtggtaaaaactttggtcaaatcgctcaagcagagttggtgaactatggtgaccaatggaaagatgttgagctagttgacggtaaggattctatctacaatcctgacaaggctaaagctgctttcgaaaaagctaagaaagacttggaatctaaaggggtaacattcccaattcacttggatgtcccagttgaacaaacagataccatcgctgttcaacaaagcaactctttcaaacagtctattgaatcaactcttggtgctgaaaatgttgttatcgacgttcttcaaatgacagataatgaaaaggaaacaatcacttctcaagcgcgtgttccttctcaaaaagattatgatttgaacagtacaggatgggctccaagctatcaagacccagcatcttacttgaatatcatggatcctaaatcaggttctgctatgaaacaccttggtattactaaagggaaagataaggatgttgtagctaaacttggtttggaccaatataagaaattattggatgatgcagattcagaaactacaaatcttgaagaacgctatgaaaaatatgccaaggctcaagcttggttgacagatagttcattattgatgccaacagcctcatctggtggttctccagttgtaagtaatgtcgtgccattctcaaaaccatactcacaagttggtattaagggtgacccatatatctttaaaggaatgaaattgcaaaaagatattgttacaacaaaagaatatgaagaagcactgaaaaaatggcaaaaagaaaaattggaatcaaatggtaagtaccaaaaagaactagaaaaacacattaaataatgcggaaaactctatatcggacaagcccgatatagagttttttcttgctagttttgggattttcttgtaaaatagaaaaagtgaagagaggtatgaaatgagtaagaaagayaaaaaaattgaaattcaagtagcagatgccaaggttaatgtaggaaaagacagttttgaaggctatacattgacaattggtaaaaaagttatcggagaaattgccgaattagacggacaatttgccatcataaagaatggaaacgtcgatagtttttataaaaaattggaaaaagctgtggaaattttgattgaaaattataatttagcaaaataagtcttgtttttttgaaattttcatgatataataatccatgttgattgtaggagagatagcgaagaggctaaacgcggcggactgtaaatccgctccttcgggttcgggggttcgaatccctctctctccatttcatcaatggggtatagccaagcggtaagrcaagggactttgactccctcatgcgttggttcgaatccagctaccccagttcttaggtaatgatcaagataaaaagcaaaatatcttagggtattttatttttataattgaaagacgtgaacgatatgaacatgtccttgcgggtgcttaggaaaaaaattataagtatgtcaagtttaagaaaaacttgattgttggaggattttttagatgaacgaatttgaagatttgctaaatagcgttagccaagttgagactggtgatgttgttagtgctgaagtattgacagttgatgcgactcaagctaacgttgcaatctctggaactggtgttgaaggtgtcttgactcttcgcgaattgacaaacgatcgcgatgcagatatcaatgactttgttaaagtaggagaagtattggatgttcttgtacttcgtcaagtagttggtaaagatactgatacagttacataccttgtatctaaaaaacgccttgaagctcgcaaagcatgggacaaacttgttggtcgcgaagaagaagttgttactgttaaaggaactcgtgccgttaaaggtggactttcagtagaatttgaaggtgttcgtggatttatcccagcttcaatgttggatactcgtttcgtacgtaacactgagcgttttgtaggtcaagaatttgatgctaaaatcaaagaagttgacgctaaagaaaaccgcttcatcctttcacgtcgtgaagttgttgaagcagctacagcagcagctcgcgctgaagtattcggtaaattggctgttggtgatgtagtaactggtaaagttgcacgtatcacaagtttcggtgctttcatcgaccttggtggtgttgacggattggttcacttgactgaattgtcacatgaacgtaacgtatcaccaaaatcagttgtaactgttggtgaagaaattgaagtgaaaatccttgatcttaacgaagaagaaggacgcgtatcactttcacttaaagcaacaacacctggaccatgggatggcgttgagcaaaaattggctaaaggtgatgtagtagaaggaacagttaaacgtttgactgacttcggtgcatttgttgaagtattgccaggtatcgatggacttgttcacgtatcacaaatttcacacaaacgtattgaaaatccaaaagaagctcttaaagttggtcaagaagttaaagttaaagttcttgaagttaacgcagatgcagagcgcgtatcactttctatcaaagctcttgaagagcgtccagctcaagaagaaggacaaaaagaagaaaaacgtgctgctcgtccacgtcgtccaaaacgtcaagaaaaacgtgatttcgaacttccagaaacacaaacaggattctcaatggctgacttgttcggtgatatcgaactctaatcaaattgaaaatacacaaaatcctttgtttacttaacaagggatttttcttttgtctgtaagtcttttttgatataatagttctatgttagaatcagaaaaacaatcacgttatcaaatgttaaatgaagagctctcttttttattggatggtgaaaccaatgttttggctaatctttccaatgccagcgctcttctaaaatcacgcttccctaataccgtatttgcaggcttttatctgttcgatggaatggaattggttttaggtcctttccaaggcggtgtttcctgtatccgtattgcacttggaaaaggtgtttgtggggaggcagctcactttcaggaaacggytctagttggtgatgtaaggacttatcccaactatatttcttgtgatggtcgagctaaaagtgaaattgttgttccgatggttaagaatggtcaattgctcggggttctggatctggattcttcagagtttgatgattatgatgctatggatcgagattatttggaacaatttgtcgctattttgcttgaaaagacagaatgggactttacaatgtttggggagaaagcctaatgtatcaagcactttatcgaaaatatagaagtcaaaacttctcccagttggttggtcaagaagttgtggctaagactcttaaacaagcggtggagcaagagaaaataagtcatgcttatcttttttctggtcctcgtggaacgggaaaaaccagtgtagctaagatatttgccaaggctatgaactgtccaaatcaagtgggtggggaaccttgtaataactgctatatttgtcaggcagtgacggacggtagtttagaagatgtcatcgaaatggatgcagcttctaataatggggtcgatgaaatccgtgaaattcgtgataaatctacctacgcccctagtcttgcccgttataaggtttatatcatagacgaggttcacatgctgtctacaggagcttttaatgcccttctaaagacgctggaagagccaacacagaatgtggtctttattttggccactactgaattgcacaagatacctgctacgattctatctcgtgtgcaacgttttgaatttaaatcaattaagacacaggatattaaggagcatattcgctatatcttagacaaagaaaatatcagttctgaaccagaagctgtggaaatcattgctagacgggctgaaggtggaatgcgggacgccttgtctattttagatcaagccctgagtttaacacagggaaatgagctgacgactgctatctctgaagaaattactggcacaattagtctatcagccttggatgattatgtggctgccttgtctcaacaggatgttcccaaggctttgtcttgcttgaatcttctttttgacaatggtaagagcatgactcgttttgtgaccgaccttttacactatttaagagacttgttaattgttcaaacagggggagaaaacactcatcatagtccagtctttgtagaaaatttgacacttcctcaagaaaatctgtttgaaatgattcgcttagcgacagtcagtttagcagatattaagtctagtttgcagcctaagatttatgctgagatgatgactatccgtttggcagagattaagcctgaaccagctctttctggggcagttgaacatgaaatttctgcattgagacaggaagttgcgcgtcttaaacaagaactcgcaaatgtgggaactgtacccaagacaacaagtccagcacctagtcgcccagcagcaggccagacagtctatcgtgtggatcgcaataaagtgcaatctatcctacaagaggccgtcgaaaaacctgatttagcacgtcaaaacctgattcgtttgcagaatgcctggggagaagtgattgaaagtcttggtgggccggacaaggctttgctagttggttctcaaccggttgccgccaatgagcaccatgctattcttgcttttgagtctaacttcaatgctggtcaaaccatgaaacgggacaatctcaacaccatgtttggtaacatcctcagtcaggcagcaggtttttcacccgaaattttagccatttccatggaggaatggaaagaagttcgagcagccttttcagccaaagccaaatcttctcaaactgaaaaagaagcagaagaaagtctgattccagaaggatttgaatttttggctgataaagtgaaggtagaggaagactaaagaaagatttcatgatacaataagtttatgaatagacaacaatttattatcattgcgctgtttacagctgctgagacctattttttcaatgaagcttggatgactggtcgttatattatggcagccttttgggccattttgctctttagaaattttcgagtaagttacttgatgggcaaaatagtggatgtcattgaccagcatttaaaaggaaaagactagtcctcagcttctagacaaaatcaaagccttttaggcttttttttgttatactataaaagtatatttattgaccttttaccgtattttctagggaaatcaagtatgtttccagtaagaactgtaaaggccttgaaaaagaaaggaactatcatgtcagtattagagatcaaagatcttcacgttgagattgaaggaaaagaaattttaaaaggggttaacctgaccctgaaaacaggagaaatcgccgctatcatgggaccaaatggtacaggtaaatcgactctttctgcagctatcatgggaaatccaaactatgaggttaccaaaggtgaagtcttgtttgatggcgtaaacatccttgagttggaagttgacgagcgtgcgcgtatgggacttttccttgctatgcaatacccatcagaaattcctggaattaccaatgctgagtttcttcgtgcagccatgaatgctggtaaagaagacgatgagaagatttcagttcgtgagtttatcactaaattggatgagaagatggaattgctcaacatgaaagaagaaatggctgagcgttacctcaacgaaggtttctctggtggtgagaaaaaacgtaatgagattcttcaacttttgatgttggagccaacatttgcccttttggatgagattgactctggtcttgatattgacgctcttaaagttgtgtctaagggtgttaatgccatgcgtggtgaaggctttggtgctatgattatcactcactaccaacgtcttttgaactacatcacaccagacgtggtacacgtgatgatggaagggcgtgttgtcctttcaggtggtccagaattggctgcacgtttggaacgtgaaggatacgcaaaactagctgaagaacttggctacgactacaaggaagaattgtaattccctcgtatcttttaggagaagtaaatgactaaagaaaatattaaacttttttcagaaatgcacgctgaaccaagctggttggctgacctccgtcaaaaagcttttgataagattgagagtttagagttaccagttattgagcgtgtcaaattccaccgttggaatctgggtgatgaaacgattacagaaagtgagccatcagcaaatgttccagatttcactgcactagataatcacttgaagttggtgcaagtaggaactcaaactgtttttgagcaaattccagttgagttggctgaacagggtgtcgtctttacagacttccactcagctttagaagaaattccagagcttattgaagaattcttcatgtcatctgttaagtatgacgatgacaagttggcagcctaccatacagcttatttcaacagtggtgctgttctctacattcctgataatgttgagattaaagaaccaatcgaaggaattttctatcaagatagtgatagcgatgtgccgtttaacaagcatattatgattatcgctggtaaaaattctaagattagttatctggaacgtttagagtcacgcggtgaaggaagtgccaaagcaactgctaatatcacagtagaagtaattgcacgttctggtgctcaagtgaagtttgctgctatcgatcgtttaggagaaaacgtcactgcctacattagccgtcgtggtaaattaggcaacgatgcaagcattgactgggcaatcggtgtcatgaacgaagggaacgtcgttgcggactttgatagtgacttgattggtaacggtagccatgcagatctcaaggttgtagctctttcaagtggtcgtcaggtacaagggattgatactcgagtgactaactatggttgcaactcaatcggaaatatcctacaacatggggttattcttgaaaaagcaactttaactttcaacggtatcgggcacattatcaagggggctaagggagcagatgcgcaacaagaaagtcgtgttctcatgctttcagaccaagcgcgttcagatgccaatccaattcttttgattgatgaaaatgacgtaactgcaggacatgcggcttctatcggtcaggtagatccagaagacatgtactacctcatgagccgtggtttagataaggcaactgcagaacgtttggttgttcgtggtttccttggctccgttatcgttgagattccagtcaaggaagttcgtgatgaaatgattgcaactatcgaagaaaaattgtcaaaacgctaaggggtagcctatgttagatgtagaagtgattcgcaaggattttccaattttagaccagattgttaatgatgaaccattggtttatttggacaatgctgcgacgacacaaaaaccactagcagttctggagacgattaaccgctactatgagaacgacaatgccaatgttcatcgtggcgttcataccttggcagaaagagcgacagcttcttatgaagccgctcgtgaaactattggtgagtttatcaatgcagggtctacaaaggaagttctctttaccagaggaacgacaaccagtctgaactgggtggcacactttgcagaggaagtcttgactgagggagaccaggttttgatttctgtcatggaacatcattccaacatcattccttggcaggaggcctgtcgcaagactggagcagagcttgtctatgtttatctcaaggacggagctctggatatggatgatttgcgaactaaattgactgacaaggtcaagtttgtttcgctagctcacgcctccaatgttcttggtgtggttaatcctatcaaagaaatcactcaattggcccatcaagttggagccatcatggtggtggatggtgctcaatctactcctcatatgaagatcgatgtccgggacttggatgtggacttctttgccttttcaggtcacaagatggctggtccaactggtattggtgttctttatggtaaagaaaagtatctggaacaaatgtcaccagtagaatttggtggtgagatgattgattttgtctatgagcaatctgctagttggaaggaattgccttggaaatttgaggctggaactcctaatatggcaggtgcaattggacttgctgcggcagtggattatctggaaaagattggtatggatgccattgaagctcatgaacaggaattaatcgcatacgtctatccaaaactgaaggcgattgaaggattgaccatttatggttcgcaggacttggctcaacgttcaggtgtcattgcctttaacctaggtgaccttcatcctcacgaccttgcgactgctttggattatgaaggagtggctgttcgagcaggtcaccactgtgcgcaacccttgctccagtatttggatgttccagccacagctcgtgcaagtttttatatctacaataccaaggcagattgcgataagctagtcgatgccttacaaaagacaaaggagtttttcaatggcactttctaaactagatagcctttatatggcagtggtagcggaccattcgaaaaatccacatcaccaagggaagttggaagatgctgagcaaatcagtctcaacaatccgacttgtggggatgttatcaatctctctgtcaagtttgatacagagaatcgtttggaagatatcgcttttctaaactcaggttgtaccatctcaactgcctctgcaagcatgatgacggacacagttttaggaaaaaccaaagaagaaattttagaacttgcgactattttttctgaaatggttcaagggcaaaaagatgaacgccaagaccaactaggcgatgcagctttcttatcaggcgttgcaaaattccctcaacgaatcaagtgtgcaaccctagcttggaacgctttgaagaaaacaattgaaaatcaagaaaacaagtaaggcaagtttcttttgtcttatgaatcagtagaaatgaagaatgaaagaaaggatattatggctgaagaaagagtagaaccaaaaccaattgaccttggtgaatataaatttggtttccatgatgatgtagagcctgtcctatcgacaggaaaaggattgaatgaagatgtcattcgtgaactatcagctgctaagggagaacctgagtggatgctagaattccgtttgaagtcttatgaaaccttcaaaaaaatgcccatgcaaacttggggagcagacttgtcagagattgactttgatgacttgatttattaccaaaaaccatctgataaaccagctcgttcatgggatgaggttcctgaaaaaattaaagaaacctttgaacgtatcgggattccggaagctgagcgtgcctatctagcaggtgcctctgcccagtatgagtcagaagtggtttaccacaacatgaaggaagagttccagaagttggggattatctttacagatacggattctgccctcaaggaatacccagacttgtttaaacaatactttgctaagttggtaccgccaacagataacaaattggctgcccttaactcagcagtatggtctggtggaacctttatctacgtaccaaaaggggtcaaggtagatattcctcttcaaacttacttccgtatcaacaacgagaatacaggtcagtttgaacgtaccttgattatcgttgatgagggagcaagtgtccattatgtagaaggatgtacagcgccaacttattcaagtaacagcttgcacgctgccatcgtagaaatctttgccttggatggagcttatatgcgttatacgactatccaaaactggtctgataacgtctataacttggtaaccaaacgtgctaaagctcaaaaggatgccactgttgagtggattgatggtaacttgggtgctaaaacaaccatgaaatacccatctgtttacctagatggagaaggggcgcgtggtaccatgctctctattgcctttgccaatgcagggcaacaccaggacactggtgccaagatgatccacaatgctccacataccagctcgtctattgtgtctaaatccatcgctaaaggcggaggaaaggttgactaccgtggacaggtaacttttaataagaactctaagaaatctgtttctcacatcgagtgtgataccattatcatggatgacttgtcagcatcagataccattccgtttaacgaaattcacaactcacaagtcgctttggaacacgaagctaaggtatctaagatttcagaagagcaactctattacctcatgagccgtggattgtcagaatctgaagcaactgagatgattgtaatgggatttgtagaaccctttacaaaagaacttccaatggaatatgcagttgagctgaaccgcttgatcagctacgaaatggaaggatcagttgggtaaaatttgattttagatttacccaaggtcaagaactttgaagatgaacttctaacaaaaaatcgcggtttaaaatcgcgatttttttataatttttcgttgatgaagcggataaactgattccaccaaacttttaagaagaaggctttttcaactttcttttctgctaccatttcaaaactaggacgttctgtagtgatgtaaccttgaccaatcaaatcattgtcttcataagttaaatgaccaaccactgttccggcttcaagtggtgctgggattgctttagaatcaggtgtgaattgaacagattgagaagattgacccccaacacgttcaattagagagatatcatctttggcaatagcagtgactgtatcttcttttccatcttgtacaggggctttactatcttggtaggcatcgcctttttgaacgattttacgaagtgtgaatgtagaagagatataatccattagtgaagatgtagctgtgaagcgagcgtaaggattattgtcttgatgatctgcattcaaaacaactgtgataaccctcatccctttttcaacagtagtaccaacaaaagattctccagccttgtctgttgttcctgtcttaaggccatcaaaaccaccgcgataagcaggcataccctctaacatgtagttggtagaagtgattgtcattccagcaaaagtagaagaaggttttttcgtgatttccaagacttgtgggtattttttgatgaggttgcgagcaacgatagcgacatcataagcactgagcttattttcctcatcttttttagaacctgggtaaatgttatcccctagagtctcattgttaagacccgtcgtattaacaacagtggcatcctgaattccccattccaagagttttgcgcgcatcatatcgacgaaatctttttctgagccagcaattttctcagctagggcaatagccgcactgttagcactagatactagggttgcttcaagtagttgttcgacggtgtaattacgagcctccataggaacgttactcgcttcagaatttgtcgttaatttgtaaggataatcagaaatatctaccggagttgatagtgtaatactgccattttccaaggcttcatagacaagataaacagtaattaactttgtgattgaagcaatttcaactggctgggttgcatctttctcatagagaattttaccagtattcgcctcaacggcaattgcatgtttagcagcaatattaaaatcttgagcagcaacagtagatgctgagccaataacggaaaggcttaaaagagttaaaattatttttttcatagtaagtttattctatcataaagaaaaaaatattcccagtttcatgatataagaaagaagcttttttgaaagtgtggtaaaatagatgaatggaggtacctcatgtttcgtaagaataaattatttttttggaccagtgagattttactattaaccattatcttttatttatggagagagatgggagcgattattacaccttttgtaagcgttgcaaacactataatgattccctttcttttaggtggttttttatattatttgaccaatcctattgtaaattttttacaaaagtatttcaaaattaaccgtatcattggtattctactaaccttgtgcgccttggtttgggggctagttattggggtagtctatctcttaccgattttgattaatcagctgacaagtttgattgcaacaagtcagacaatttatagtcgtttgcaagatttgattgtggatttatcywmytwwycmrscyttymaaawttwrrwwwtymarssrmsrwtymammrktwaawyyyyycywwkkwrrwawtyywmmrrawatycywaawwgkkkaamsratwrkgttggragtgtcctwtctgcgctctttagtacygttttgattattatcatgacccctgtatttttaatttattttttgttagatggtcacaagttcttgccgatgcttgaacgtactgttttaaagcgagacaagttgcatattacaggtcttttaaaaaatttgaatactacaattgctcgatatattagtggagttgctattgatgcgattattattggttgtttggcctttatcggatatagcgtaatcggtttgaaatacgctttggtcttcgctatcttttcaggattagccaatctcattccttatgtaggcccaagtattggtttgattccgatgattatcgctaatgtctttactgatcctcatagaatgctgattgcagttgtttatatgctgattattcaacaagtggatggaaatattctttaccctcgaatcgttggtggtgtgatgaaggttcatccaattacgattttagtattacttttgttatcaagtaatatctatggtgtcattggtatgattgtcgcagtaccaacctattctatcttaaaagaaatttctaagtttttatcacgcttgtatgaaaatcataaaataatgaaagaacgagaaagagaattagctaagtaaaagtcaggaaattcctgatttttctttttcattaaagaagtgataggagtagaattaccgtttagattagcagattaagaataattcacaaaaactttgtaaaacacttgcaatttagctgaaatttgataaaatagtaaggaaagttagactgtattgcctactgtctatctataaaatatattttattggaggcttttactcaaatggcaaaagaaaaatacgatcgtagtaaaccacacgttaacattggtactatcggacacgttgaccacggtaaaactactttgacagcagctatcacaactgttttggcacgtcgcttgccttcagctgttaaccaacctaaagactatgcgtctatcgatgctgctccagaagaacgcgaacgtggtatcacaatcaacactgcgcacgttgagtacgaaactgaaaaacgtcactacgctcacatcgacgctccaggacacgcggactatgttaaaaacatgatcactggtgccgctcaaatggacggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagctcttaaagcccttgaaggtgacactaaatacgaagacatcgttatggaattgatgaacacagttgatgagtacatcccagaaccagaacgtgacactgacaaaccattgcttcttccagtcgaagacgtattctcaatcactggtcgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgccggagataatgtaggtgtccttcttcgtggtgttcaacgtgatgaaatcgaacgtggacaagttattgctaaaccaggttcaatcaacccacacactaaattcaaaggtgaagtttacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgatccacccaatcgccgtagaacaaggtactacattctctatccgtgagggtggacgtactgttggttcaggtatggttacagaaatcgaagcttaattcgatttagttcccagaagaacaattatttaagtcagacactaaaagaatcttgctatgcaaggttctttttttctgatattgaactaaaattgaagaattgtacacaaaaaagctctatacacttgatgggcatagagcaaacggagctttatctgatatagagttcttggtttttcaagacaatttcacgtacgcttgcaaactttttgagttttttgatttcttctggatgagtgacgagagtgataacatagccttctttacccatgcgacctgtacggccagcacggtgagtgtaggtttcaatatctctaggaacatcaaagtttacgacacattctaggctatcgatatcaattccacgtgccagaaggtctgttgcaagaagtagggttagttgcttgtctttaaacttttctaagatgacttttctaaatttgacattgacatcactagcgagggaaacagccaggatatcccgatattgtagtttttcttctgcacttccaaggtctgataggctgttaaagaagactagaccacggaaatcctctacatgagccagttttcgtagcatatccactcggtgacgttgctctacctgcatgtagaagtgctggatgttgtccagtttttgatcagagagattaatggtacgtgtgttaggcgcaatcttcttttggtcaaacttggttgtcgcactcatatagacaagttggtggtcacgaggtgcgtagtgagtaattttctcgacaaagtgtatctgagaatcatctagtaattggtcgaattcatccaggatgatggtttccacattcatcatcttgatttttttcaatttaatcagttcaaagatacggccaggggttccaatcagaatttctggtccttttttgagtcgttcaatttgacgtttttgactcgaacctgataagaagagttgggtagttaagcagatagcttcagcccacgttttacatacatcaaaaatctgtccagcaagctcagtatttggtgctagaatcaagagttgttggttttttttcttttgtagtctgagaagacttggtagaaggtaagctagggtcttaccagttcctgttgggctcactcctaggaggttttctccagcaagaaggggctcaaatagttgggtttgaatgggagtgaattcttggaaaccgagttggtcactcagttcttgccattcagtcggtagtttgtttttcatttttctgcctcaaatctaatgccagcagtctggcgcatggtaaatagtagttcatgaacaaaacttgcatcttccaaccaagtttggtagagattcagatctggttgctggatcatgtgtgcaaatgcagcgacttcctcagtcattgtatgaggagcctgttggatagggagttggacttgattgccttgatggtcggtaaaaatagccgagcgaacatgctcaatcgtgttgagagtcaaggttccatctgttgtgtaaatttcgcaaggaagattggaagtgatgtttttcccagccttgatgtgaacttgaaagtctgggtagaagaggatgccatcgccatttaggtcaatgctattgtcaagctgttgagcctgataggtcacatccttagcttttccaaagagacgaacggcagcgtagaggggataaatccccaaatccataagagctccaccagcaaaacgatctgaaaagacatttggtgtctgtccagccaacaagttaggcattttggaagaatacttggcatagttgaaatctgctcccaaaattagtttgtctgctaaaaagtttttgatgatagtgaaagctttttcatggtagttccgtgccgcttcgaagataaaacagtgatttttctcagctgtatgtctcaaatctagccattcttgtggatgagtgacagctggcttttcaagaatgacgtgcttaccagcagacaaggcagccttggcttgaacaaaatgcaaggagtttgggctagcaatatagaccacatcaaaggagctcttgaagaagtcctctacttgatcaaagagttggatattctgatagcgagaagcaaaggttgccgcagtttctagttttctagaatagattgcgaccagcttgtattctccactggaatgggctgcttctatgaagtggtggctgatagcccctgttccgatgatacctaatttaagcatagtgactccttttccgatttcaaatccttctttcattataacatagatagacgggactatccaacagaggggaaaaaatttcaaataatctactaggtcttttccaaagaaagtggtacaataatgagatgagtaaatgaaatgggagggaaaatgaggttattacctataagaaaaatatcacgtcagtctaagaggctagcgctttttttgactttttgtgcaggatatgtagacgcctatacttttattgtgcgagggaatactcttgtagctggacaaactgggaatgtcgtctttctatcagtggggctcattcaacacaatgtttcagatgctagtgccaaagtaatgaccttgctagcttttatgatgggggtctttttactaacgatttataaggaaaaattga

SEQ ID NO: 61 - DNA, 84457 bp, Streptococcus mitis NCTC 12261 contig7
tgaaaaagccaattctgtcactgattcctttggcaatcttatcaatcattattggttttgtgccgcaaactgtagataatatctatctagtaccgccattagccttttgtatgggcttggtgacaactgcttttggtgaggtttcgggtattgcctataataacgcgtttatgacagggaatatcaaacggaccatgctggcttttggagattattttcggaccaagcacactccttttttacgtgaagggattatctttgttagcctgcttagtagttttgtccttggcgttgtcttttcagcttatttgacgattttctatcatgaaaagaccattcttggtgttcctattatgatgagcattttttacctcagcatgctttttgcctcttggcagaaaaaagtaaaagaaaaagcttcattttaggtgttattacttgtaagaaaataggagatatgctatacttgaagagttgactatgcacgatcctgtgcaaccgcacgaacatcgttgcttgattattcaagtttaagtggtttgtcccacgatgctaggcgagtcttcacaaaaaattcggggaaacccataaaaatcataggaggtgcataatgagcacatacgcaattatcaaaactggcggaaaacaagttaaagttgaagttggtcaagcagtttacgttgaaaaattgaacgttgaagctggtcaagaagttacttttaacgaagttgttcttgttggtggtgaaaacactgttgtcggaactccacttgttgctggagctactgtagttggaactgttgaaaaacaaggaaaacaaaagaaagttgttacttacaagtacaaacctaaaaaaggtagccaccgtaaacaaggtcaccgtcaaccatatactaaagttgtcatcaacgcaatcaacgcttaattttaaggagaacacatgatacaagcagtctttgagagagccgaagatggcgagctgaggagtgcggaaattactggacacgccgagagtggcgaatacggcttagatgtcgtgtgtgcatcggtttctacgcttgccattaactttatcaattctattgagaaatttgcaggctatgaaccaatcctagaattaaacgaagatgaaggtggctatctgatggttgaaattccaaaagatcttccttcacaccagagagaaatgacccagttattctttgaatcatttttcttaggtatggcaaacttatcggagaactcttctgagttcgtccaaaccagagttatcacagaaaactaacacggaggaaaacattatgttaaaaatgactcttaacaacttgcaacttttcgcccacaaaaaaggtggaggttctacatcaaacggacgtgattcacaagcgaaacgtcttggagctaaagcagctgacggacaaactgtaacaggtggatctatcctttaccgtcaacgtggtacacacatctacccaggtgtaaacgttggacgtggtggagacgatactttgttcgctaaagttgaaggcgtagtacgctttgaacgtaaaggacgcgataaaaaacaagtttctgtttacccaatcgctaaataaaaaggtccagtgaacctttttatcccgagccttgaatataaaggcgaggaagctagaagtagcataaactaaggctttccgagttttcggagagcctatttttttattttgatacccacgctgatacccatattttaaaaaccaatgtaagaagcgaacttgtcggctactttgtcttttagatacaattataaaatagtggaatgtgagccttttacagtaatgaatgttataagggaataagatattgtaaaaattgctaagatttgatattataattgtatctgagtaaggaagcaggaatatggaaaggagtgagcctatatgaaaaaattatcataatgatagtctgttcaatctcttttcttgttttatctgcttgcgttagtaacaaaaaacttattcttcctgaacctgaaacgatctctgtaatttccctgcagaaaacaatctctgaagatattaaaactataaccaagagagaagaaatctcaaaattgattgaggagatacagaaacagtccaaatctacaactttggagagtttcaatgatcaaccgacaaatgttaaagattacatcattatcaaattcactcatcagaatgaagaaaatgatagtgtagcctatctatatactatgaaagaaaaacagtatattgagcaaccctatgttgggatttgggaggtaagtccagatatagcgaatagggttgaagaagcttattctagttgatttatagaataaaagaaatttttagagagttttcttgtatcatgttttaaacggtaaatcaacaagatttgctgtttttatttgtttgaaataaaatgaggactgaaaaaagatatcattctaattcttgtattggggtattagagtattcgcttagacttgaaaatttccagacttttttcctttttggaaaacttctaaaatatggtataatgaaaagataaagaagttgggggtagaagatgaacattcaacaattacgctatgttgtggctattgcgaatagcggtacttttcgtgaagctgctgaaaagatgtatgttagtcagccgagtctgtctatttctgttcgtgatttggaaaaagagttgggctttaagattttccgtcggaccagctcagggactttcttgactcgtcgtggtatggaattttatgaaaaagcgcaagaattggttaaaggatttgatatttttcaaaatcagtatgccaatcctgaggaagaaaaggatgaattttccattgctagtcagcactatgacttcttgccaccaaccattacggccttttcagagcgctatcctgattataagaactttcgtatttttgaatcaactactgttcaaattttagatgaagtagcgcaagggcatagtgagatcgggattatctacctcaacaatcaaaataaaaaaggtattatgcaacgggttgaaaagctaggtctggagatcattgaattgatttccttccatacccacatttatctccgcgaggggcatcctttggctcagaaagaggaattggttatggaggatttagctgatctaccaacggttcgtttcactcaagaaaaagacgagtacctttattattcagagaactttgttgataccagtgcgagctcgcagatgttcaatgtgacagaccgtgctactttgaatggtattttggagcggacggacgcttatgcaacaggttccggatttttagatagtgacagtgtcaatgggattacagtcattcgtctcaaggataacctagataatcgcatggtctatgttaaacgtgaagaagtggagctgagtcaagctgggactctctttgtagaagtcatgcaagaatattttaatcagaagaggaaatcatgaaaaaaagaggaatagtggcagtcattgtactacttttgattgggcttgatcagttggtaaaatcctatatcgtccagcagattccactgggtgaagtacgctcttggattcccaatttcgttagtttgacctacctgcaaaatcgaggtgcagccttttctatcttacaagatcagcagttgttattcgctgtcattaccctggttgtcgtggtaggtgccatttggtatctacataaacacatggaggactcattctggatggtcttgggtttgaccttgattatcgcaggtggtcttggaaactttattgacagggtaagtcagggctttgttgtggatatgtttcacttggactttatcaattttgcaattttcaatgtggcagatagctatctgactgttggagtgattattttattgattgcaatgctaaaagaggaaataaatggaaattaaaattgaaactggtggcctgcgtttagataaggctttgtcggatttgacagaattatcacgtagtctcgcgaatgaacaaatcaaatcaggacaggtcttggttaatggtcaagtcaagaaagctaaatacacagttcaagagggtgatatcgtcacttaccatgtaccagagccggaggtcttagagtatgtggctgagaatcttccgctagatatcatctaccaagatgaggatgtggccgtcgttaacaaacctcaggggatggtggtgcatccgagtgctggtcatactagtggaactctagtaaatgcccttatgtatcatattaaggacttgtcgggtatcaatggggttctacgcccaggaattgttcatcgtattgataaggatacgtctggccttctcatgattgctaaaaacgatgaggcgcatctagcacttgcccaagaactcaaggataaaaagtctctccgaaaatattgggctattgttcatggaaatctgcctaatgatcgtggtgtgattgaagctccgattggccgtagtgaaaaagaccgtaagaaacaggctgtgactgctaaagggaagcctgcagtgacccgtttccacgtcttggaacgttttggtgattacagcttggtagagttgcagctagagacaggacgcactcatcaaatccgtgttcacatggcttatattggccatccagtcgctggtgatgaggtctatggtcctcgcaagactttgaaaggacatggacaatttctccatgccaagactctaggctttacccatccgagaacaggtgagaccatggaatttacagcagatatcccagagatttttaaggaaacattggagagattgagaaagtaagaatgaaaaagaaattaactagtttagcacttgcaggtgcttttttatgcttgtcatttcatgggaatgttcaagctcaagaaagttcaggaaataaaatccactttataaatgttcaggaaggtggcagtgatgcgatcattcttgaaagtaatggacattttgccatggtggatacaggagaagattatgatttcccagatggaagtgattctcgttacccatggagagaaggaattgaaacatcttataagcatgttctgacagatcgtgtttcgcgacatttaaaggaattgggtgtccaaaaacttgattttattttggtaacccatacccatagtgaccatattggaaacgttgatgagttactgcaaacctatccagttggtcgtatctacatgaaaaaatactctgatagtcggattacaacaccaactcatctatgggataatctgtatggctatgataaggttttacagacttctgcagaaaaaggtgtttcagttattcaaaacattacacaaggagatgctcattttcagtttggggacatggatattcaactctataactatgaaaatgaaactgattcatcaggtgaattaaagaaaatttgggatgacaattctaattctttgattagtgtagtgaaagtcaatggtaagaaaatttacctcggaggagatttggataatgctcatggagcagaagacaagtatggtcctctcattggaaaagttgatttgatgaagtttaatcatcactatgataccaataaatcaaacaccaaggatttcattaaaaatttgagtccgagtttgattgttcaaacttcggatagtttaccttggaaaaatggtgttgatagtgagtatgtcaattggctcaaagaacgaggaattgagagaattaacgcagccagcaaagactatgatgcgacagtttttgatattcgacaagatggttttgtcaatatttcaacttcttacaagcagattccaagttttcaagctggttggcataagagtgcttatggaaactggtggtatcaagcgcctgactctacaggagaatatgcagttggttggaatgaaatcaagggtgaatggtattacttcaaccaaacgggtatcttgttacagaatcaatggaaaaaatggaacaatcgttggttctatttgacagactctggtgcatctgctaaaaattggaagaaaatcaatggaagctggtattatttcaacaaagaaaatcagatagagactggttggcttaatactggcggtcagacctattatctatcaaatgatggggatatgataacaggatggcgtaagattgatggacaatggtactattttgctcaatcaggggaaatgaaaacgggctgggtaaaagataaagaaacctggtactatatggattctactggtaccatgaagacaggcgagatagaagtttctggtcatcattactatctagaagaatcaggagctatgaagcaaggctggcttaaaaaggcaaatgattggtatttctataaggaagacggttcacgagctgttggttggattaaagacaaggataaatggtacttcttgaaagaaaatggtcaattacttgtgaacggtaagacaccagaaggctatactgttgattcaagtggtgcctggttagtggatgttccggtagagaaatctgctacaactagagatacaagtaactcagaaataaaagaatccaatgaagtagtgaaaaaagatcttgaaaataaagaaacgagtcaacacgaaagtattacaagttcttcaactagtcaagatttgacttcttcaacttcacaaagcactgaaacaagtgcaaataaatcggaatcagaacagcagtaaaaaagaaggttttagggccttctttttcctatcaactcttttctatttcctgccattcatgttataatggataaatatgaagaatcggagtgagactatgaaattcaaacggattgtctttaaggtggggacttcttctctgacgaatgaggatggaagtttatcacgtagtaaggtaaaggctattacccagcaattggctatgttgcacgaagctggtcatgagttgattttggtgtcgtcgggtgccattgctgctggttttggagccttaggatttaaaaagcgtccgactaagattgctgataaacaggcctcagcagcggtaggacaagggcttttgttggaagaatacacgaccaaccttctcttgcgccaaatcgtttctgcacaaatcttgctgacccaggatgactttgtggataagcgccgttataaaaatgcccatcaggctttgtcagttctacttagtcgtggggcaattcctatcatcaacgagaatgacagtgtcgttattgatgagctcaaggttggggacaatgacactcttagtgcccaggtagcggccatggtccaagcagaccttttagtcctcttgacagatgtggacggtctctatactggaaatcctaattcagatccaaaagccaaacgcttggagaaaatcgagaccatcaatcgtgagattattgatatggctggtggagctggctcgtcaaatggaactgggggcatgctaaccaaaatcaaggctgcaactattgcgacagaatcaggagttcctgtttatatctgctcatccttgaaggcagatgctatgattgaggcggctgaggagaccaaggatggttcttactttgttgcgcaagagaagggacttcgtacccagaaacaatggcttgcattctatgctcagagtcagggttctatttgggttgataaaggggctgcagaagctctctcccaacatggaaagagtcttctcttatctggtgtagttgacgcagaaggggccttttcttacggtgatattgtgacagtatttgacaaggaaagtggaaaatcacttggaaaaggacgcgtgcaatttggagcatctgctttggaggatatgttgcgttctcaaaaagccaaaggtgtcttgattcaccgtgacgattggatttccattactcctgaaatccaactactctttacagaattttagaggtaaattatggtaagtacacaagaacaatttgaacaggtacaggctgttaaaaaatcgattaacacagctagtgaagaggtgaaaaaccaagccttgctagccatggctgatcacttattagcagctactgaggaaattttagcagccaatgcccttgatatggaagctgctaagggtaaaatctcagatgtaatgctggatcgtctttatttggatgcaagtcgtatagaagcaatggcaaccgggattcgtgaagtggttgctttaccagatccaatcggtgaagttttggaaacaagtcagcttgaaaatggcttggttatcaccaagaaacgtgtagctatgggagttattggtataatctatgaaagccgtccaaatgtgacgtctgatgcggctgctttggctcttaaaagtggaaatgcagttgttcttcgtagtggtaaggatgcctatcaaacggcccatgccattgtcacagccttgaagaagggtttggagacaacgaccattcatccagatgtgattcaactagtggaagataccagccgtgaaagtagctatgctatgatgaaggccaagggctatctagacctgctcattcctcgtggaggggctggtttgatcaatgcagtggttgaaaatgctattgtaccagttatcgagacaggaactgggattgtccatgtttatgtcgataaggacgcagatgaggacaaggcactgtctatcatcaacaatgccaaaactagtcgtccttctgtctgcaatgccatggaggttctacttgttcatgaagacaaagcagcaagcttccttcctcgcttggagcaagttctagttgcagagcgcaaggaagctggactggagccaattcaattccgtgtagatagcacagcaagtcagtttgtttcaggtcgagtagctgaggcccaagactttgacaccgagtttttagactatgtactagctgttaaggttgtgagcagtttagaagaagcagttgctcatattgaaacccacagtacccatcattcggatgccattgtgacggagaatgctgaagttgcagcttactttacagatcaagtagactctgcagcagtctatgtcaatgcctcaacgcgtttcaccgatggtggccaatttggtctgggttgtgaaatgggaatttctactcaaaaactgcacgcgcgtggtccaatgggcttgaaagaattgaccagctacaagtatgtggttactggtgacggacagataagggagtaaaaaatgaagattggatttattggtttgggaaatatgggagctagcttggccaaggctgttttgcaggccaagacgggtgatgaccttctccttgccaatcgcagtcaagccaaggtggatgctttcattgccgactttggcggtcaagcttctagcaatgaagaaatctttgcagaagcagatgtgatttttctaggtgttaagccagctcagttctcagacttgctttctcaatatcagaccattcttgaaaaacgagggagtcttcttttgatttcgatggcagctggattgactttggaaaaactcgctaatcttctgccaagtcaacaccgaattattcgtatgatgccgaatacccctgcttctatcgggcaaggagtgattagttatgccttgtctcctaattgcagggctgaggacagtgagctattttgtcagcttttaagcaaggctggcctcttggttgaacttggggaaggcttaatcgacgcggcgacaggtcttgcaggttgtgggccggcctttgtctatctctttattgaggccttggcagatgcaggtgttcagactggattgccacgagagacagcattgaaaatggcggctcaaacagtggtaggagctggtcaattggtcctagaaagccaagagcatcctggagtattgaaagaccaagtctgcagcccaggaggttcgactattgctggtgtagcgagcttagaagcgcatgcttttagaggaacggtcatggaggcagttggtcaagcctacaaacgaacacaagaattaggtaaataagaggtagttttgtctgcctcttttatggtggctgatactcttcgaaaatctcttcaaactgcgtcagattccatctgcaacctcaaaacagtgttttgagcaacctgcggctagcttcctagtttgctctttgattttcattgagtattaaatgagaagacaaaaaagattgtcacaaacccctattttttgatagaatagaagtagtaaaaaagaaatgagttagacatgtcaaaaggatttttagtctctcttgagggaccagagggagcaggaaagaccagtgttttagagactctgctaccaattttagaggaaaaaggagtagaggtgctgacgacccgtgaacctggcggagtcttgattggggagaagattcgggaagtgattttggacccaagtcatactcagatggatgcgaagacagagttacttctttatattgccagtcgcagacagcatttggtggaaaaagttcttccagcccttgaagctggtaagttggtcattatggaccgtttcatcgatagttctgttgcctatcagggatttggtcgtggcttgaatattgacgccattgactggctcaatcagtttgcgacagatggcctcaaacccgatttgacactctattttgacatcgaggtggaagagggactggctcgcattgctgctaatagcaatcgtgaggtcaatcgtttggacttggaaggattggacttgcataaaaaagtccgtcaaggttacctttctcttctggacaaagaaggaagtcgtattgtcaagattgatgctagttttcctttggagcaagttgtggaaactaccaaggctgtcttgtttgatagaatgggattagctaaatgaaacaagatcaactaaaggcctggcaaccagatcagtttaaccgctttgtccgtatcctagaacaagaccagctcaatcatgcctacctcttttcaggtttctttgaaagtttggaaatggcgcaatttttagctaagagcctcttttgtacagataaagtaggtgttttaccatgtgagaaatgccgaaattgtaagctgattgaacagggagaatttcccgatgtcaccttgattaaaccagttaatcaggtcattaagacagaacgcattcgagaattagtgggtcagttttcccaagcagggattgaaagccagcaacaggtttttattattgagcaagctgagaagatgcatcctaacgcagctaattctctgctcaaggtcatcgaagaaccccagagtgaggtttatattttcttcttgaccagagatgaggagaagattttaccgacaattcgaagtcggacccagattttccactttaaaaaacaagaagagaagctgatattgctcttagaacaaatgggactggttaagaaaaaagcgactctcctagcccagtttagtcaatcgcgagctgaagcagagaagttagccaatcaggcaagtttttggaccttggttgatgaaagtgaacgcctgctgacttggttagtggactaaagaaaaaagaaagttatttgcaagttgccaaactagctagcttggcagatgataaggaaaaacaagatcaggttttacggattcttgaagtcctctgtcgggaggatctcctgcaagcaagagtaagagtgattctacaagatttgctagaagctagaaaaatgtggcaagctaatgtcagctttcaaaatgccatggaatacctggtcttgaaagaaatataaactcaaagatgaatgataaagaaaggaaagggctgttttatggacaaaaaagaattatttgacgcgctagatgatttttcccaacagttattggtaaccttggccgatgtggaagccatcaagaaaaatctcaagagcctggtagaggaaaatacagctcttcgcttggaaaatagtaagttgcgagaacgcttgggtgaggtggaagcagatgctcccgtcaaggctaagcatgttcgtgaaagtgtccgtcgaatttataaagatggttttcacgtatgtaatgatttttatggacaacgtcgagagcaggacgaggaatgtatgttctgtgacgagttgttatacagggagtaagcatgcagattcaaaaaagttttaaggggcagtctccctatggcaagctgtatctagtggcaacgccgattggcaatctagatgatatgacctttcgtgctatccagaccttaaaagaagtagattggattgcagctgaggacacgcgcaatacagggcttttgctcaagcattttgatatttccaccaagcagattagttttcatgagcacaatgccaaggaaaagattcctgatttgattggtttcctgaaagcaggacaaagtattgctcaggtatccgatgcgggtctgcctagtatctcggaccctggtcatgatttggtcaaggcagccattgaggaagaaattgcggttgtgactgttccaggtgcctctgcaggaatttctgccttgattgccagtggtttagcgccacagccacatatcttttacggctttttaccgagaaaatcaggccagcaaaagcaatttttcgacttgaaaaaagactatcctgaaactcagattttctatgaatcgccccatcgtgtggcagatacgttggaaaatatgctagcagtttatggtgaccgctcggtggtcttggttagagaattgaccaaaatctatgaagaataccaacgcggtatcatttctgagttattagaaagcatctctgaaacgcctctcaagggtgaatgtcttctcatcgttggaggtgccagtcaggatgtggagaaaaaagacgaggaagacttgttctcagaaatccaagctcgcatccagcaaggcatgaagaaaaaccaagctattaaggaagtagctaagttttaccagtggaataagagccagctttacgcagcctaccatgactgggaagaaaatcaagaaaatgactaaacagggaagtttgccttcttccctttttttgttatactagtagaagaaaaaattagaaagatttgtgggagtgaaaaagtcctgtggactttttcagcctgagccaagaaacttgaaagcgaagtaagtcctgtggactttttcagcctgagccaagaaattcgaaagctaggcaagttcggttggctttttcaatgtgaaacttgtcttcacactcccaaagaggtattagtgtcgtgtctcaatcttatatcaatgttatcggtgctggtttggcaggttctgaagctgcctaccaaattgcagagcgtggtattccagttaaactttatgaaatgcgtggtgtcaagtcaacaccccagcacaaaacagacaattttgcagagttggtttgttccaattctcttcgtggggatgctttgacaaatgcagttggtcttctcaaggaagaaatgcgtcgcttgggttctgttattttggaatctgctgaggctacacgtgttcctgcaggtggtgcgcttgcggtggaccgtgatggtttctcccaaatggtgacagaaaaagttaccaaccatcccttgattgaagtggttcgtgatgaaattacagaattaccgacagatgttatcacagttgtcgctactggtcccttgaccagcgatgccctagctgagaagattcatgctcttaatgatggcgatggtttctatttctacgatgcggcagcgcctattatcgatgtcaatactatcgatatgagcaaggtctatctcaagtctcgttatgataagggagaagccgcttatctcaacgctcctatgaccaagcaagagtttatggatttccatgaagccttgatcaatgcggaggaagcaccactcaattcttttgaaaaagaaaaatactttgaaggatgtatgcctatcgaagtcatggccaaacgtggcattaaaactatgctttatggtcctatgaaaccagtgggtctggagtatccagatgactacacaggacctcgtgatggagaattcaaaacaccgtatgcggtggttcagcttcgtcaggacaatgcggctggtagcctttacaatattgttggtttccagacccacctcaaatggggagaacaaaagcgtgtcttccaaatgattccaggtcttgaaaatgcggagtttgtacgttatggtgtcatgcaccgcaattcttacatggattcaccaaatcttcttgagcagacctatcgttccaagaaacagccaaacctcttctttgctggtcagatgacaggtgtggaaggctatgttgagtcagctgcttcaggcttggttgcgggaattaacgccgctcgtctcttcaagggagaaagcgaggctgttttcccagagaccacagcgattggaagtctggctcattatatcacccatgctgacagcaaacatttccaaccaatgaatgtcaactttgggattatcaaggagttggaaggcgagcgtattcgtgataagaaggctcgttatgaaaaaattgcagagcgcgctcttagcgacctagaagaatttttaactgtctaatttttttgaaagaattgctcatgatactataaaaatcttagaaattgtgataaaataggtaggataaaagaaggagagtgaaaatggcgaatcccaagtataaacgtattttaatcaagttatcaggtgaagcccttgccggtgaacgaggcgtagggattgatatccaaacagttcaaacaatcgcaaaagagattcaagaagttcatagcttaggtatcgaaattgcccttgttattggtggaggaaatctctggcgtggcgaacctgctgcagaagcaggaatggaccgcgttcaggcagattacacaggaatgcttgggactgttatgaatgctcttgtgatggcagattcattgcaacaagttggggttgatacacgtgtgcaaacagctattgctatgcaacaagtggcagagccttatgtccgtggccgtgcccttcgtcaccttgaaaaaggccgtatcgttatctttggtgccggaattggttcaccttacttctcaaccgatacaacagcggcccttcgtgcagctgaaatcgaagcagatgccatccttatggctaaaaatggtgtcgacggtgtttacaatgccgatcctaagaaggacaagacagctgttaaatttgaagaattgacccaccgtgacgttatcaataaaggtctccgtatcatggactcaacagcttcaaccctctcaatggacaacgatattgacttggttgtctttaacatgaaccaaccaggcaacatcaaacgtgtcgtatttggtgaaaatatcggaacaacagtttcaaataatatcgaagaaaaggaataagaaagattatggctaacgcaattattgaaaaagctaaagagagaatgacccagtctcaccaatcacttgctcgtgaatttggtggtatccgtgctggccgtgccaatgcaagcttgcttgaccgtgtacatgtagaatactatggagtcgaaactcctcttaaccaaatcgcttcaattaccattccagaagcgcgtgttttgttggtaacaccatttgacaagtcttcattgaaagacatcgaacgtgctttgaacgcttctgatcttggtatcacaccagcgaatgacggttctgtgattcgcttggttatcccagctcttacagaagaaactcgtcgtgaccttgctaaagaagtgaagaaggtcggtgagaatgctaaggtggctgtccgcaatatccgtcgcgatgctatggacgaagctaagaaacaagaaaaagcaaaagaaatcactgaagacgaattgaagactcttgaaaaagacattcaaaaagtaacagacgatgctgttaaacacatcgacgacatgactgccaacaaagagaaagaacttttggaagtctaaaaataaacagaaaaactcagttggcattgctggctgagttttattcgaaagaaggaaatatgaatacaaatcttgcaagttttatcgttggactgatcatcgatgaaaacgaccgtttttactttgtgcaaaaggatggtcaaacctatgctcttgctaaggaagaaggtcaacatacggtaggggatacggtcaaaggttttgcctacacggatatgaagcaaaaactccgcctgaccactctagaagtgaccgccactcaggaccaatttggttggggaactgtaacggaagttcgtaaagacttgggtgtctttgtggatacaggccttcctgacaaggaaatcgttgtgtcactcgatattctccctgagctcaaggaactctggcctaagaagggcgaccaactttacatccgtctcgaagtggacaagaaagaccgtatctggggactcttggcttatcaagaagacttcaaacgtctggctcgtcctgcctacaacaacatgcagaaccaaaactggccagccattgtttaccgcctcaagctgtcagggacttttgtttacctgccagaaaataacatgcttggctttatccatcctagcgagcgctacgcagagccacgtttgggtcaagttttagatgcgcgtgttattggtttccgtgaagtggaccgtactttgaacctatcccttaaaccacgttcctttgagatgttggaaaatgatgcccagatgattttgacctacttggaaagcaatggtggtttcatgaccttgaatgacaagtcatcccctgaggatatcaaggcaacctttggaatttctaaaggtcagttcaagaaagcactcggtggcttgatgaaggctggtaaaatcaagcaagaccagtttgggacagagttgatttagggagacatatgagaaaatcattttacacttggctcatgaccgagcgcaatcctaaaagtaacagtcccaaagctatcttggcagacctagcttttgaagagtcagcctttccaaaacacacagatgattttgatgaggtgagtcgctttttggaggagcatgccagtttctcttttaacctaggagactttgacgctatctggcaagaatacatagagcactagcatgattcactgggtttgggctagtaatttctccacccctttgctataataaaaagaaataaaaggattagagaggttctttatttgaaggaacattcaatagacattcaactgagtcatccagatgacctgtttcatctttttggttccaatgaacgccatcttcgtttgatggaagaagagcttgatgtggtgattcatgctcgtacggagattgtccaggttttgggagaagaggctgcttgtgaggaagcccgtcaggttattcaagctctcatggtcttggtgaaccgtgggatgaccgttggtacgccagatgtggtgactgcaattagcatggtcaaaaacgatgaaatcgacaagtttgtcgccctttacgaagaagaaatcatcaaggataatacagggaaacctatccgtgtcaaaacactgggtcaaaaactttatgtggacagtgttaaacagcatgatgtgacctttggaattgggccagcaggaacagggaagacctttcttgcagtgaccttggcagtgactgctcttaaacgtgggcaggtcaagcggattatcttgactcgtccagcagtggaagcaggagagagtctaggttttcttccgggtgatcttaaggagaaggtagatccttaccttcgacctgtttatgatgccttgtatcagattctgggaaaagaccaaacgactcgtctcatggagcgtgaaattatcgagattgcgccccttgcctacatgcgtggacggaccttggatgatgcctttgtcattctcgatgaggcacaaaatacgaccatcatgcagatgaagatgttcttgacgcgtttaggctttaattctaagatgattgtcaatggagatatcagtcagattgaccttccgcgtaacgtcaagtccggtttgattgatgcccaagaaaagctcaagaacattcaccagattgactttgttcatttttcagccaaggatgtggttcgccatccagttgtcgctcagattatccgagcttatgaaccagctccagttaaaaatgaagagcgtgaagaagtccaagaagaaacagaataacaaaaaagagcagttcaggtggacttgctctttcttttatctgataattatattttttagactagttcatcaattggagtatgttttttatcgagaccttgggctactggaagactggttaagtaaccttgataagtggtcacaccttgacgcaagcccttatcttcagagattgcttgtataaaacctttaccagccaaagcttcgatataaggaagagtgacattggttagggcgatggttgaagtacgggcaactgcaccagggatgttggcaacggcatagtggagaacgccgtatttttcatagacaggttcatcgtgcgttgtgacacggtcagctgtctcgataatgcccccttggtcaacggcgacgtccacaatgacagagcctggacgcatttgcttgaccatctcatctgtcaccaattttggtactttggcacctgggatgagaaccgctccgatcaccacatccgcatctctcacactggcttcgatgttgagcgaattggacataagggtttgaatttgatgaccaaagacctcctctaaaacggagagacgtttagcactgatatcaaggatggtcacttgcgctcccaatcctaaagcgatgcgggcagcatgggtccctacgacaccaccaccgatgatggttacttttcctttaggtacacccggtacaccacccagtaggacgccagaacctcctgcttgtttggttaggaagtgagctccgatttggactgccatacggcctgcaacctcactcataggaacgaggagtggtaactggccttgggaatcatggacagtttcataggcaatccctgttgtttttgctgctagcatagcatctgctaattcaggagcagcggccatgtgcaagtaggtgaagagaagcaggtcgtcacgcaagtactcatattcagaaggtaatggttcttttactttcacgactaactttgcagcccaagcttcaccagcactagcgacaatttcagctccttgcttttgatagtcagcatcagtaaagcctgaaccgagaccagcatttgtttcgataaggacgcgatgaccacgaccgactaagctgaggacaccagcaggtgtgagggcaacacggttttcattattcttaatttcttttggaattccgattaacatagagaaaaactccctttctattgacgggttgtaaatgatttatcacattatctataaaaataaggtgatgattttattctatatgaaaccgctttaaaaagcaaggaaaacttgttgtaacttcttttttatgctagactgatagaaaatacttttgaatggtagaaacgtatggaatcaatctttttaaaactagctcagtatccaatagtcgagactgagcgtttattgcttagacctgtaaccttggatgatgcagaagaaatgtttgactatgcctcggataaggataatacacgttacacttttctaaccaatcaaaatttagaagaaaccaaaaataatattgctcagttctacttggctaatcccttgggacgttggggaatagaactaaaaagcaatggcaaatttatcggaacaattgatttgcacaagattgatcctgctcttaagaaggcggctattggctacattatcaataaaaagtattggaatcaaggattaacgacagaagccaatcgtgccgtgattgagctggcttttgagaagattggaatgaacaagttgaccgcccttcacgataaggataatcccgcatctggcaaggtcatggagaaatcaggcatgcgcttttcccatgaagaaccatatgcttgtatggaccagcatgaagaaggccgaatcgttacaagagttcattatgtcttgaccaaggaagactattttacatataaataagcagttgagaagaaattttcaactgttttttcttcctcttacgaataatctaagagaggagaaaatatggaagcaattatcgagaaaatcaaagagtataaaatcattgttatctgtactggtctgggattacttgtcggaggatttttcctgctaaagccagctccacaaacacctgtcaaggaaacgaatttgcaggcagaagttgtagcagtttccaaggattcggtatccgaaaaggaagtaaagaaggaagaaaaggaagaaccccttgaacaagatctaatcacagtagatgtcaaaggtgctgttaaatcgccagggatttatgatttgcctgtaggtagtcgagtcaatgatgctgttcagaaggctggtggcttgacagaacaagcagatagcaagtcgctcaatctagctcagaaagttagtgacgaggctctggtttacgtcccaactaagggagaagaagcagctagtcagcaggcaggtcctgggacggcttcctcaacgagcaaggaaaagaaggtcaatctcaataaggccagtctggaagaactcaagcaggtcaaaggactgggtggcaaacgagctcaggatattatcgaccatcgtgaggcaaatgggaaattcaagtcggttgatgaactcaagaaagtctctggcattggtgccaagaccatagaaaagttaaaagattatgttacagtggattaagaatttctctattcccctaatttaccttagttttctgttgctttggctttactacgccattttctcatcatcttatctcgcactactaggttttgtttttctgctagtctgtctctttatccaatttccgtggaaatctgctggtaaagttctaataatttgtggaatctttggtttctggtttctgtttcaaaattggcaacagagtcaagcgagtcaaaatttggcggattctgttgaaagggtacggattttaccagacactgttaaggtcaatggtgatagtctatcctttcgtggtaagtctgatggacgcatttttcaagtctattataaactccagtccgaggaggagaaagaagcctttcaagctttaaccgaccttcatgagataggactagaaggaaaactttcagaaccagacgggcagagaaattttggtggttttgactaccaagcctatctgaaaactcaagggatttaccaaacattaactatcaaaagaatccagtcacttcaaaaggttagcagttgggatataggagaaaatctgtccagtttacgtcgaaagactgtggtttggattaagacgcattttccagaccctatgcgcaattacatgacagggctcttgttaggacatctggacaccgactttgaggagatgaacgggctttattctagtttaggaattatccacctctttgccttgtcgggtatgcaggtaggttttttcatggacggatttaagaaactcctcttgcgattgggcttgactcaagaaaagttgaaatggctgacttatcccttttcccttatctatgcagggctgacaggattttcagcatcagttattcgcagtcttttgcaaaagttactggcacaacatggtgttaagggcttggataattttgccttgacggtccttgtcctctttatcgtcatgcccaactttttcttgacagcaggaggagtcttgtcctgcgcttatgcttttatcttgaccatgaccagcaaagaaggagaaggcctcaaggctgttgctagagaaagtctagtcatttccttgggaatattacccatcctatccttctattttgcagaatttcagccttggtctatccttttgacctttgtcttttcctttctttttgacttggtcttcttaccgctcttgtctatcttatttgccctttcctttcttcatccagtcattcagctgaattttatttttgaatggttggagggaatgattcgctttgtatcacaggtggcaagtagacctctggtctttggacaacccaatgcatggattttaatcttattgttaatttccttggctttggtctatgatttgaggaaaaacattaaaaggctagcagtgttgagcttattgattacaggtctctttttcttgaccaagcatccactggaaaatgaaatcaccatgctggatgttgggcaaggggaaagtattttcctacgggatgtaactggtaaaatcattctcatagatgtgggtggcaaggcagagtctagtaagaaaatagaaaaatggcaagaaaagacgacgaccagtaatgcccagcgaaccttgataccctatctcaaaagtcgcggagtatccaagattgaccagctaattttgaccaatacggacaaggaatatgttggagatttgttggaggtgaccaaggcttttcatgtaggcgaaattttagtgtcaaaaggcagtttgaaacagaagcaatttgtggcagaactacaagcgacccaaacaaaagttagaagtataacagcaggagagaacttgtcaatttttggaagtcagttagaagtcctatctccaaggaaaattggagatggaggttatgaagattccctggttctgtatggaaaacttttggataagtactttctcttcacaggaaatttggaggaaaaaggagagaaggaattgctgaagcactatccagacttgaaagtggatgttttaaaagctggccaacatggctctaaaaaatcatcaagttcagactttctagaaaaactcaaaccagagtttactcttatctcagttggaaagaacaatcgagcgaaactcccccatcaggaaactttgacacgactggaaactatcaatagtaaagtttaccgaactgaccagcatggagctatacgctttaaagggtggaatagttggaaagtcgaaacggttggttaatgagcagaaacttttcaaaaaaataactttttatcttgacaagagctagaaaacttggtatcatgtaaaagttgagaaaagcagaagtgagagcttctcgccttgtgacatgaagttgcctggccctacggatgaaaagtttctaagaaacgctatcataacgtgcgggcttgtatatttacgagtccgctattgtttttctctaataaaacaaaagaggtgaaaaccatagcaaagcaagacttattcatcaatgatgagattcgtgtacgtgaagttcgcttgattggtcttgaaggagaacagctaggcatcaagccactcagtgaagcgcaagctttggctgataacgctaatgttgacctagtattgattcaaccccaagccaaaccgcctgttgcaaaaattatggactacggtaagttcaagtttgagtaccagaagaagcaaaaagaacaacgtaaaaaacaaagtgttgttactgtgaaagaagttcgtctaagtccaactattgacaagggtgactttgatacaaaacttcgcaatgcacgcaaattccttgaaaaaggaaataaagttaaggtatctattcgctttaagggtcgtatgattacccataaagagattggtgcaaaagttttagccgagtttgctgaagcaactcaagatattgccatcatcgaacaacgtgctaaaatggatggacgtcaaatgttcatgcaattggcgccagcgactgacaaaaaataattgtcagaaagttaaataaaggagaaaaaatcatgccaaaacaaaaaacacaccgcgcatcagctaaacgtttcaaacgtacaggttctggtggacttaaacgtttccgtgcttacacttctcaccgtttccacggaaaaactaagaaacaacgtcgtcatcttcgtaaagcatctatggtgcattcaggagattacaaacgtatcaaagcaatgcttactcgcttgaaataatagcttgactgtaagtaaacaattctaggaaatatttggaggaaataaaacatggcacgtgttaaaggtggcgttgtatcacgcaaacgtcgtaaacgtattcttaaattagcaaaaggttactatggagctaaacacatcttgttccgtactgcaaaagaacaagtaatgaactcttactactatgcataccgtgaccgtcgtcagaaaaaacgtgacttccgcaaattgtggatcactcgtatcaatgcggcagctcgtatgaacggactttcatactcacaattgatgcatggtttgaaattggctgagatcgaagttaaccgtaaaatgcttgctgacttggctgttaacgatgcagcagctttcacagctcttgcagatgcagctaaagcaaaacttggtaaataataattgattgtttcattttgccttatgcggtgtatgccgtaaaaggcaggatgaaacttttttattttccataaatgattttctattttagagagtaaatcacagattttttcaaagaaaataggatatttcttgtataataggaatatctaaaaagatttggagttagaagaagatgatagtaggtattgatttaggaacgactaattctttagtaggagtataccaagatggccaggtcaagctgcttcccaatgcttttggtgaatatttgactccttctgttgtggctttagatgacaatgatgaaatcatagttggaaaaattgccaaggaacgcttggtgacacatcctgacagaactctttctcagttcaaacgatttatggggaccaaacatgaattggtcctaggaaatagaacctataaagcggaggaactaagttcttttgtcattcgaaaattagtggatgatgcagagagtttccttggtgagaaagttgaggaagtcattgtcagtgtaccagcttattttaacgatgcacaacgctatgctacaaaattggcagggcaatttgcaggggttaaaatagagcgtatcatcaatgaaccttccgcagctgctctcgcaaaaaaatctatgagcaatcaagaagaccaatcttttgtggttgtcgattttggtgggggtacgctagatatctcggttgttgagttgtttgataacgttgtagagattgtgtctatcgcaggtgataatcgattgggaggagaggattttactgcagcaattgctgaggaatttttaacctcaaatcacttgtctaggaaatctatttcacgagagttttacagcaagatattggttcaagcggagaaggcaaagttgaatctgaatatcaatgaagaagtgcagatgctagtaatggatcaggaaaaggagtactctttagacctaacttatcagagattttatgagctttgtcagcctttgcttgcccgacttaagtctgtattagatagagccttgagggatgcccgatatagttatgtgtcctctgaaaattttgtccttgtcggcggtacctcaaaacttcgtttagttcaagactttctatcttactgtattgaccaagcggttcaattaactgatgatcctgataaaatgattgcaaaaggttgtgctcttctagcgggaataaaggggcgtcagggagaagttcgagacttattgttatcagatatttgtccttttacgcttggaacttcagtagtgggtgatcgtttttctccgattatcgaacgtaattctcctttacctacttcaaaaaaggaacattattacactgcagaactgggacaaagtcaagtgagagtagaagtctatcaaggagaaatgatgaaggcttcacaaaacttatttctaggagaattggaagttcctgtgcctgtaaaccatgaagttaacgaaggtctcactatacgattcacctacgacttaaatgggattttagatgtggaagtaaccatcgactcaacacaggaagtctttaaccatgttattcttcaagagagtatcactctgactgaagaggaaatcaaagaaaaacaagccgagctgactcgctataagattaatgcccaggaaactgaggtttaccgtttcttgattgaaaaagccaatcgtgtgtatagcatgctattagggagaagaagagatgagttgatggcagaaactagacgctttgaagaagaagtcaaacaagcatctatgtatcatttaccaaaactttatcaatcattttctaactatctagaatttctagaacgaggtctatgagaggggattgtatgagcaagtgggaaatcttaggaattgagccaactcatgacgttaagcttattagaagacgttatgcagagctggttcgactctatcacccagaggaccaaccagaaatctaccaacaaattgtggaagcctaccagtctgctttgagagaagcacggtctaaaaagaccaggcaagaaagtggtagaagtgaagctagctccactcagcagatcaatgagcaagaaaacagaacgacaaactctgctaccaattcacttgattttgaattatttaagtctgaggagaaaactgagcaagtagatactgcacaaccttctcttgacttcggtgatgttcatgagactgctgcttcaaatgaaagttacaatgaaccagtcgctcctcgactaaattttgaaacggtcaatgaagatacaagttctcaagaggtagctgcatctagaaatgtcttagatttcagtgattatctagagttagagtatttgattcgaaatgcgattgaaagtattgtagggaatcctgactataccatagaagaacaagaacatctttggaaacagttttttagtcaatatggatatgatatgagcactgttcagtctgttttagaagaaatggatgtttatatttttaacaaacctgagcaattctctatcatcattcccttactggaagactatgtaccagactttaagtgctggggttattactataaactgaagcattggaaggttaaaagggctactgcctacaaaaatggagagtcccttgaagatgcaaaaaaagaaatttcgaatttgtatgcttcttatcgtttatgtcaagcaatcctcgaagattcccaaaaagtcaatcaaattggggtttggataaaattttttaaacaatctttttctcctagtacggttctttttctgttgaataacagtaaacaaatgattacttgcattccagtattggcttatattcttgatatgataggtcaagtaaagactaatgaggaccaaaaagcctatgatgaacttctagcttactttgaggaattacaagcagattcagaagaaccattcgatatccattcttataatttgctaaatctttcagaggttgaggaagccctatatctcttagtctatacgccatatcaagacgaggctagacttgtagaatcttggaaacaccttctagaaaagactcaggataaatctctcttacttcaattattagaggaaattgatgtttatccatttacaaataagaaggttttgaatcttgtttttcgatttgtagaaaataacatcaaggatggagaaaatccttatctaaagaaattcaatttttggaatgatatttattactatccttgggctatcaagaaatatgagttaaataaaaaagagaaatttgattactggtattatgagggatatctatttgtcgataaattgttaaaagatgataaacttgtcaatgattggacgatttggaaacaagtttttaaagagaaacctcgcatttatcctatcttttttgaacaagtttataaggagtatcaccgttttacagatggagaactattgaagtttatattgggtcaatttcatacttctagcatggctccgctcttgatgacagaggagacagacctgaaactcgaagagatgactcaccacgcatatcaactcaatcatccgaatcctaaagtatcttatcttgcttggattaaaagagatgttcttaaaaataggctcttaacttttacctttgcgactttaaccattatcagttttcttctaagcgtctatgacgaacctggtttaaatagatggctatacataggaatggtttctctctataattattacatgcataggagacttgaccaaccaatcaaagaaggactcaatgcccgagggcaaaaaataaaattttattataatagaaatctttgggttttagcagtaatactgctttcctttgttccagttattccacttggactcatctcttgtctattatttataagcattttttctattattgatggtttccatgttcgttatgggttgagagtgacctattctttgaacaagttaattcctctcggactgtttttatctgctggttttctagttgctctggcaaaccgaagtgaaaagatttcatatattgtaatttgttacatctttatttctatgatagttgttggtattctatactttacaagattttggataggatttccaccctcactgaaggaaattatttttccgattataatgggtgttatattctttcaattattacctctaattcacagtcgcttaagtctatttaatccagttattctaagaaatgaaactttgagcttaacttttttacttttattaaatggaatcgtattggcttattttacaaaagagcagcgtttagcaattggtgttaagaagacctttatgatttatggattgcagatttttattttcctaagacggttatttagaattctattcatccctataccagattttagcaaaatcttttttgaaaaagacctgttaatattgaacaatgagtttactttctacttccttgaggggctttttatccttatcatgctttttcttattcgcaatatacgcaaagaaaatcgtaaaagtgctgcttagaataaaatagtagagaagaggactctagttcaagtttctagtaaattttcctgaataaaggtataatagaactattaaaatgaaagaggtaatgaatatggcttcaaaaatgctacacacttgcttgcgagtagaaaatctcgaaaaatcaattgcattttatcaagatgcttttggatttaaagaattgcgtcgcagagattttccagaccatgccttcacgattgtctatctaggtcttgagggtgatgactatgagttggagttgacttataactacgatcatggtccttatgtggttggagatggatttgcccatatcgccctcagtacacccgatcttgaagctcttcatcaagagcacagtgcaaaaggctatgaagtgactgagccaaatggtctaccaggaactgcacctaactattactttgtcaaagaccctgatggctacaaggtcgaagtcattcgtgaaaaataatttcttgaagtcaagtagaatgttcgttttttacttgactttttttagctgaaagagtataatagtaaaaatttaacctttaaggggagtccagagagactcacaaggtgtcagataaaagaatagtacaattttctagaggagactttttaagtgtgctctcttgtgttgtacgattttaactgaggccttgcactagcaaggtcttttctttatctggtccccttaaaatttaaggaggaaaagtcatgaatcccacatgtaagaaacgtttgggtgcaattcgtttggaaaccatgaaggtggtagcacaggaggaaatcgcgccagcaatctttgaattagtcctagaaggggaaatggttgaagccatgcgagcaggccaatttcttcatctgcgtgtgcctgatgatgcccatcttttgcgccgtcctatttcgatttcatctattgataaggttaagaagcagtgtcatctcatttatcggattgaaggggctgggacagctattttctcaaccttaagtcagggggatactcttgatgtaatgggccctcagggaaatggttttgatttgtctgatctagatgagcagagccagattctccttgttggaggggggattggcgtaccgcccttgcttgaggtagccaaggaattgcatgcgcgtggtgtgaaagtagtgacagttctcggttttgccactaaggatgctgttattttagagacggaattagctcaatatggtcaagtttttgtaacgacagatgatggttcttatggtatcaagggaaatgtttccgttgttatcaaggatttagacaatcaatttgatgctgtttactcatgtggggctccaggaatgatgaagtatatcaatcaaaccttttatgaccacccaagagcctatttatctctggaatctcgtatggcttgtgggatgggggcttgctatgcctgcgtcctaaaagtgccagaaagcgagacggtcagccaacgcgtctgtgaagatggccctgttttccgcacaggaacagttgtattataaggagaaaattatgactacaaatcgtttacaagtttctctaccaggcttggatttgaaaaatccgattattccagcatcaggctgttttggttttggtcaagagtatgccaagtactatgatttagaccttttgggttctattatgatcaaggcgacaacacttgaagcccgttttggcaatccaactccaagggtggcagaaacacccgctggtatgcttaatgcaatcggtttgcaaaatcctggtttggaagttgttttggctgaaaagttaccttggctagaaagagagtatccaaatcttcctattatcgccaatgtagctggtttttcaaaacaagagtatgctgctgtttctcatggtatttccaaggcagctaatgtgaaggctattgagctcaatatttcttgtcccaacgtagatcactgtaatcatggactcttgattggtcaaaaccctgatctggcttatgatgtggtgaaagcagctgtggaagcttctgatgtgccagtttatgtcaaattaacccctagtgtgaccgatatcgttactgtcgcaaaagctgcagaagatgcgggggcaagtggcttaaccatgatcaatactctggttggtatgcgctttgacctcaaaacaagaaaaccaatcttggccaatggaacaggtggaatgtctggtccagcagtctttccagtagccctcaaactcatccgccaagtcgcccaaacaacagacctgcctatcattggaatggggggagtggattcggcagaagctgccctagaaatgtatctggctggagcatctgctattggagttggaacagccaactttaccaatccatatgcctgtcctgatatcatcgaaaatcttccaaaagccatggacaaatacggcattagcagtctggaagatctacgcaaggaagtaaaagagtctctgaggtaaactgcaatcaatctgttcttgattttttatcagtttgtaatgttgattatagagaattttgatacaataaaatggaaagaacagaggaagaaagtttatgaagaaattgagatttgtttttttagctctgctatttttcttagccagaccagagagtgcaatggctagtgatggtacttggcaaggaaaacaatacctgaaagcagatggtagtcaagcagccaatgagtgggtttttgatactcattatcaatcttggttttatatcaaagcagatgctaactatgctgaaaatgaatggttgaaacaaggtgacgactatttttacctcaaatctggtggctatatggcaaaatcagaatgggtagaagacaagggagtcctctattatcttgaccaagatggaaagatgaaaagaaatgcttggctaggagcttcctatgtcggtgctacaggtgccaaggtaatagaagactgggtctatgattctcaatatgatgcttggttttatatcaaagcagatggccagcacgcagagaaagaatggctccaaattaagggcaaggactattatttcaaatccggaggttatttactgacaagtcagtggattgaacaggcttatgtgagtgctagtggtgctaaagtacagcaaggttggctttttgacaaacaataccaatcttggttttacattaaagaaaatgggaatcatgctgataaagaatggatttttgataatggtcactattattatctaaaatccggaggctatatggcagccaatgaatggattttggataaagaatcatggttttacctaaaatctgatggcaaaatggctgaaaaagaatgggtctatgattctcatagtcaagcctggtactacttcaaatctgctggctacatggcaaaaaatgagactattgatggtcatcagctaggaaacgatggaaaatggcataaggagtccaagactagctctgattattatcaggtccttccagtgactgcaaatgtttatgatgcagatggtgaaaagctctcctatatatcgcaaggtagtgtcgtctggctagataaggatagaaaaagtgatgataagcatctggctattactgtttctggtttgtcaggctatatgaaaacagaagatttacaagcattagatgctagtaaggattttatcccattttatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactatagtgctgaagacttggataaggtatttagtttgctaaatattaataatagtctcttagaaaataagggagctacttttaaggaagccgaagaacattatcatatcaatgccctttacctccttgcccatagtgctttagaaagtgattggggacgaagtaagattgccaaagataagaataatttctttggaattacagcctatgatacgaccccttacctttctgccaagacatttgatgatgtggataagggaattttaggtgcaagcaagtggattaaggaaaattatatcgataggggcagaactttccttggaaacaaggcatctggtatgaatgtggaatatgcctcagatccttattggggtgaaaaaattgctagtgtgatgatgaaaatcaatgagaagctaggtggcaaagattagtcctataattgatactcttcgaaaatctcttcaaaccacgtcagcgtctccttgggtgatgtatgtgattgactttgtcagtcttatctacaacctcaaagcagtgctttgagcaacctgcggctagcttcctagtttgctctttgattttcattgagtatgaatatgatttgagtgagtataagttaaaaatcctgatttcaagtaaaatcaggattttttcatggatgcaattttttctgggtctggtgtgacacggagggtcttttgtcctgtgtaagtgacaaagcctggttttccaccagttggtttattgagtttcttgacttcaatcatatctacctgcaccagatttgacaggcgtccttgagagaagtaggcggccagctctgctgcgtctgtcttgacttcatcagatgggtcaagattgcctgagatgacaacatggcttccaggaatgtccttggcatggaaccaaagttcctccttgcgggccattttaaaggttagctcctcattttgcaggttattgcgaccgacatagatgatggttttgccatcgcttgctagatattgttctggttttttgcgtttctggattttctcccgttgtcttctgcggataaaacctgtttggatcaattcttcacggatttcagcgatttcttctagtccagcttggttgaggacggtttctacactttccagatagagaatggttgccttggtttcctcaatcagctcagtcaagtatttgacagcttctttgagtttctgataccgtttaaaatagcgttgggcattctggttgggagtcaaggccttatcaagcgcaattgtgataggttgattagtatagtagttgtctaggataacctgatcttggtcattaggaacttgatggaggaaggttgtcagtaattcccccttttgacgaaattcttcagcgttgtctgtcgccagtaactctttttcttgttttttaagcttatgacgatttttttgaagttcattttcaacacgacgaatgagttcactggcttgctgttttacgcggtcgcgctcagccttatccttatagtaggtgtccaacaaatcagaaagactggcaaaaggctctcccacctgatttgcaaaaggaactgggctgaaggaagtctcagtcaagcatggcttggtttcttgattgaaaaagtttcggaaagtggaaagtttttcactaaccagtatcctttccaattcatttgccgtatcgcgtcccagaccttgaaagaggctttgaagatttttagctgtcgtttcctgtgtttgcaggatttcaaaaagtttctcgtccttgattgtaaaaggattgagagcttccgtacttggcggagcgatataggtcgatccaggaagcaaggtgcggtagctattttgtgaaaagccaacatgtttgataacttcgaggattttatgactgcttttatcgaccagtagaatattactgtgtttccccataatttcgataatcaaggtagcctgaatatggtccccaatctcgtttttattagaaaccgtaatttccacaatacggtcattttccacttgctcaatcgactcaatcagggcaccctgcaaatattttcttaaaaccatgataaaggtagaaggctgggctgggttttcaaaagttgtttgggtcagctgaatgcgtccaaaaactggatgggcagaaaggagcaggcgatgactttggcgattgctacggatttgcaagaccaactcttgttcaaaaggttgattgattttctgaatgcgaccattcactaattctcttcgcaattcctcaaccatgtggtgtaaaaaaaatccgtcaaatgacatcgttctctccttgtgattgtattccatagtattatatcaaaaaggtagaataaaatcatggaaatgtggtataataaagccaagtaaagagaaacgagaagcacatgtatattgaaatggtagatgaaactggtcaagtttcaaaagaaatgttgcaacaaacccaagagattttggaatttgcagcccaaaaattaggaaaagaagacaaggagatggcagttacctttgtgaccaatgagcgtagtcatgaactcaatctggagtaccgtgacaccgaccgtccgacagatgtcatcagccttgaatataaaccagagttggaaattgcctttgacgaagaagatttgcttgaaaatccagaattagcagagatgatgtctgagtttgatgcctatattggggaattgttcatctctattgataaggctcatgagcaggctgaggaatatggccacagctttgagcgtgagatgggcttcttggcagtacacggctttttacatattaacggctatgatcactacactccggaagaagaagcggagatgttcggtttacaagaagaaattttgacagcctatggactcacaagacaataaacgaaaatggaaaaatcgtgacctgatatccagtttagaatttgctcttacaggaatttttactgccataaaggaagaacgcaatatgcgaaaacatgcggtgacggctctcgtggtcatcctcgcaggttttgtttttcaggtgtcacgaatcgaatggctctttctcctattgagcatttttttggtagtagcctttgaaattatcaattctgctatcgagaatgtggtggatttggccagtcactatcacttttctatgctggctaaaaatgccaaggatatggcggctggcgcggtattagtggtctctcttttcgcagccttaacaggcgcattgatttttctcccacgaatctgggacttaatattttaaacagtaagaggaaattatgacttttaaatcaggctttgtagccattttaggacgtcccaatgttgggaagtcaacctttttaaatcacgtcatggggcaaaagattgccatcatgagtgacaaggcgcagacaacgcgcaacaaaatcatgggaatttacacgaccgataaggagcaaatcgtctttatcgacacgccagggattcacaagcctaaaacggcccttggagatttcatggttgagtctgcctacagcacccttcgtgaagtggacaccgttcttttcatggtgcccgctgatgaagcgcgtggtaagggagacgacatgattatcgagcgtctcaaggctgccaagattcctgtgattctagtggtaaacaagattgataaggtccatccagaccagcttttgtctcagattgatgatttccgaaatcagatggacttcaaagaaatcgttccaatctcagcccttcagggaaataacgtgtctcgtctagtggatattttgagtgaaaatctggacgaaggtttccagtatttcccgtctgatcaaatcacagaccatccagaacgtttcttggtttcagagatggttcgtgagaaagtcttgcacctaactcgtgaagagattcctcactcagttgctgtagtagttgattctatgaaacgagacgaagagacagataaggttcacatccgtgcaactatcatggtggagcgcgatagtcagaaagggattatcatcggtaaaggtggcgctatgcttaagaaaatcggtagcatggctcgtcgtgatatcgaactcatgctaggagacaaggtcttcctagaaacatgggtcaaggtcaagaaaaactggcgcgataaaaaactagatttggctgactttggctataatgaaaaagaatactaagtagaggtgggctcatgcctgcttcttgtttttacagaaggaggacttatgcctgaattacctgaggttgaaaccgttcgtcgtggtttagaaaaattgattctgggaaagaagatttcgagtatagaaattcgctatcccaagatgattaagacgaatttggacgagtttcaaaaggaagtgcctggtcagattgttgagtccatgggacgtcgtggaaaatatttgcttttctgcctgacagacaaggtcttgatttcccatttgcgcatggaaggcaagtatttttactatccagaccaggttcctgaacgtaagcatgcccatgttttcttccagtttgaagacggtggcacgcttgtttatgaggatgtacgcaagtttgggactatggaactgtttgcaccagaccttttggaagcctactttatttctaaaaaattagggcctgaaccaagcgaacaagaatttgatttgcaggtctttcaagctgccctagccaagtccaaaaagcctatcaaatctcacttattagaccaaaccttggttgctggccttggcaatatttatgtggatgaagtcctctggcgagctcaggttcatccagctagaccttcccagactttgacgacagaagaagcgtcagccattcatgaccagaccatttctgttttgggccaggctgttgaaaaaggtggctcgactattcggacctataccaatgcctttggggaagatggaaccatgcaggattttcatcaggtctatgacaaggctggtcaagagtgtgcacgctgtgggactgtgattgagaaaatgcaactaggcggacgaggcacccacttttgtccaaactgtcaaaggagggactgatgggaaaaatcattggaattacaggaggaattgcctctggtaagtcaactgtgacaaattttctaagacagcaaggttttcaagtggtggatgctgacgcagtcgtccaccaactacagaaacctggaggtcgtctgtttgaggctctagtacagcactttggtcaaaaaatcatccttgaaaatggagaacttaatcgccctctcctagctagtcacatcttttccaatcctgatgaacgggaatggtctaagcgaactcaaggagagattatccgtgaggaactggctactttgagagaccagttggttcagacagaagctatctttttcatggatattcccctgctttttgagcaggactatgcttcttggtttaatgagacttggttggtctatgtggatcgagatatccaagtagaacgtttaatgaaaagagaccacttgtccaaagatgaatctgaatctcgtctagcagcccagtggcctttagacaaaaagaaagatttggctagtcatgttttagataacaatggaaatctggaccagcttcttactcaagtgcgtatccttctcgagggaggtaagcaatatgacagagattaactggaaggataatttgcgcattgcctggtttggtaattttctgacaggagccagtatttctttggttgtgccctttatgcccatttttgtggaaaatctaggtgtagggagtgagcaagtcgctttttatgcaggtttagcaatttctgtctctgctatttcagcggcgctcttttctcctatctggggtattcttgctgacaaatatggtcgaaaacccatgatgattcgggctgggcttgctatgaccattactatggggggcttggcctttgtcccaaatatctattggttaatctttcttcgcttactgaatggtgtatttgcaggatttgttcccaatgcaacggccttgatagccagtcaggttcccaaggagaaatcaggctctgccttaggtactctgtctacaggcgtagttgcaggtactctaactggtccttttatcgggggctttatagcagaattatttggcattcgtacggttttcttactggttggtagttttctgtttttagctgctattttgactatttgctttatccaggaagattttcaaccagtagccaaggaaaaggctattccaacaaaggaattatttacctcggttaaatatccctatcttttggtcaatctctttttaaccagttttgtcatccaattttcagcccaatcgattggccctattttggctctttatgtacgcgacttagggcagacagagaatcttctttttgtctctggtttgattgtgtccagcatgggcttttccagcatgatgagtgcaggagtcatgggtaagctaggtgacaaggtgggcaatcatcgtctcttggttgtagcacagttttattcagttatcatctatctcctctgtgccaatgcatctagtccccttcaactaggactctatcgtttcctctttggcttgggaaccggtgcgctgattcctgggattaatgccctactcagcaaaatgactcccaaagccggcatttcgagggtctttgccttcaatcaggtattcttttatctgggaggtgtcgttggtcccatggcaggttctgcagtagcaggtcaatttggctaccatgcagtcttttatgcgacaagcctttgtgttgcctttagttgtctctttaaccttcttcaatttcgaacattattaaaagtaaaggaaatctagtgcgagtaaaaattaatctcaagtgctcctcttgtggcagtatcaattacctaaccagtaaaaattccaaaacccatccagacaagattgaggttttaaagtattgtcccaaggaaagaaaagtaaccctacatcttgaatctaagtagattttatggtaaaataatagggattttaaggagtttgatatgtataacctattattaaccattttattagtattatctgttgtgattgtgattgcgattttcatgcaaccaaccaaaaaccaatccagcaatgtatttgatgccagctcaggtgatttgtttgaacgcagtaaagcacgcggttttgaagctgtaatgcagcgtttgacagggattttagtctttttctggctagccattgccttagcattgacggtattatcaagtagataagaaaataatgggcaggactaggtctttgcctctttttatttttaaaggatgtttgaaaaggttttacagtaaaagaaaattaaaaaatctagaaagaaaatatgaaagatagaataaaagaatatttgcaagataagggaaaggtaactgtcaatgacttggctcaggctttgggaaaagacggttccaaggattttcgtgagttgattaaaaccttatccttaatggaaagaaagcaccagattcgttttgaagaagatggtactctgaccttagaagttaagaaaaaacatgagattactctcaaggggatttttcatgcccataaaaatggctttggttttgtcagtctagaaggcgaggaggacgacctttttgtaggtaaaaacgatgtcaactatgctattgatggcgatactgttgaggttgtcatcaagaaagtcgctgatcgtaacaagggaacagcggcggaagccaaaattatcgatatcctagaacacagtttgacaactgttgtcggtcaaatcgttctagatcaggaaaaacctaagtatgctggctacatccgttcgaaaaatcagaaaatcagccaaccgatttatgtaaaaaaaccagcccttaaactggagggaacagaagttctcaaggtctttatcgacaaatacccaagcaagaaacatgatttctttgtcgcgagtgttctagatgtggtggggcattcaacggatgtcggaattgatgttcttgaggttttggagtctatggacattgtctcagaatttccagaggctgttgtcaaggaagcagaaagtgtgcctgatgttccgtctcaaaaggatatggaaggccgtctggatctaagagatgagattacctttaccattgacggtgctgacgccaaagacttggacgatgcggtgcatatcaaggctttaaaaaatgggaatttggagctcggtgttcacatcgcagatgtttcctactatgtgactgaggggtctgcccttgataaggaagcccttaatcgtgcaacttctgtctatgtgacagaccgtgtggtcccaatgcttccagaacgactgtcaaatggtatctgctccctcaatcctcaagttgatcgcctaacccagtctgccattatggagattgataaacatggtcgtgtggtcaattacaccattacacaaacggtaatcaagacaagcttccgtatgacctataacgatgttaatgatattctagctggcgacgtggaaaagagacaagaatatcagaaaattgtccctagtatcgaactcatggccaagcttcatgaaattttagaaaacatgcgtgtgaaacgtggtgccctcaatttcgataccaatgaagctaagattttagtggataagcaaggtaagcctgttgatatcgttcttcgtcagcgtggtgttgctgagcgcatgattgaatcctttatgctgatggccaatgaaacagttgccgagcattttagcaagctggatctacctttcatctatcgaattcacgaggagcctaaggctgaaaaagttcagaagtttattgattatgcttcgagttttggcttgcgtatttatgggactgccagtgagattagccaggaggccctccaagacatcatgcgtgctgttgagggggaaccttatgcagatgtattgtccatgatgcttcttcgctctatgcagcaggctcgctattcggagcacaatcacggccactatggccttgctgctgactattacactcactttaccagtccgattcgtcgttatccagaccttcttgttcaccgtatgattcgtgattacagccgttctaaggaaatagcagagcattttgagcaagtgattccagagattgcgacccagtcttccaaccgtgaacgtcgtgccattgaggctgagcgtgaagtcgaagccatgaaaaaggctgagtatatggaagaatacgtaggcgaagaatacgatgcggttgtatcaagtattgtcaagtttggtctctttgttgaattgccgaatacagttgagggcttgattcacatcactaatctacctgaattttatcatttcaatgaacgtgatttgaccctgcttggggagaaatcgggtacaaccttccgtgtaggtcagcaaatccgtatccgagttgaaagagccgacaagatgacgggtgaaattgacttttcttacatcccaagtgagtttgatgtgattgaaaaaggcttgaaacaagctggttgcaaagacagagggcgtggttcaaatcgtcgttcagataagaaggaagacaagagaaaatcaggacgctcaaatgataagcgcaagcattcacaaaaagacaagaagaaaaagggcaagaaacctttttacaaggaagtagctaagaaaggagccaagcatggcaaagggcgagggaaaggtcgtcgcacaaaataaaaaggcgcgtcacgactatacaatcgtagatacgctagaggcagggatggtcctgactggaactgaaatcaagagtgtacgagcagctcgaatcaatctcaaggatggctttgcccaagtaaaaaatggggaggtatggctgagcaatgttcatatcgctccttacgaagagggcaatatctggaaccaagaaccagaacgtcgtcgaaaactcttactccataaaaagcaaattcaaaaattggaacaagagactaaaggaacaggaatgaccctggttccccttaaagtctatatcaaagatggctatgccaagctccttttaggcctagctaaagggaagcatgactacgataaacgggagtctatcaaacgacgtgagcaaaaccgcgacatcgcgcgtgttatgaaagctgttaatcagcgataaaaagaggaatgaagatggaaaaactagttgcctataaacgcatgcctttgtggactaaagaaaccatgccagaggctgttcagcaaaagcacaataccaaggttgggacttggagcaagattactgttttaaaaggaactctcaagtttattgaattgacagaggatggtgaggttctagctgaacacctatttgaagcaggggctgacaatccaatggcgcaaccacaagcctggcaccgagtggaggctgtaacagacgatgtagaatggtacttggaattttattgtaaacctgaggattattttcctaagaaatacaataccaatcctgttcattcagaggtcctagaggcaatgcagacagtaaaaccagggaaagccttggatttgggctgtggtcagggccgtaactctctctttcttgcacagaatggttttgatgtgacagctgtagatcaaaatgaattatctcttgaaatcttgcaaagcattgttgagcaggaagacctagatatgcctgttggtctttacgatatcaattcagccagtattgggaaagaatatgattttatcgtttcaacagttgttctcatgtttctacaagcggaccgcattccagctattattcaaaatatgcaggagaaaaccagtgttggtggttacaatcttatcgtttgtgctatggacacggaggattatccttgctctgtgaacttcccattcacatttaaagaaggagaattggcagactattacaaggactgggaattggttaagtacaatgaaaatcctggccatcttcaccgtcgcgatgagaatggcaatcgtattcaactacgctttgcgaccatgctagctaagaaaatcaaataaacatgaatgaagattaggaattttcctgatcttttttcttttttacgaataatatagaaaaggagggaaatcatgtttgttgcgagagattctaggggagaattggtaaatgtgttagaggataagcttgagaagcaagcatacacctgcccagcttgtggaggtcagctccgtttgcgtcaaggaccaagtgtccggatccattttgcccacaaaaccttaaaagactgtgatttttcctctgaaaatgaaagtccagaacatctggaaaataaggaagtcctttatcactggttgaaaaaagaggccgaggtgcaattagaatacctgcttccagagcttaaacagattgcggatgtatttgtaaatggcaatctagctttagaggttcaatgtagtcccttgcctcaaaaagttcttaaagagcgtagcgagggctatcgtagtcagggttaccaagtactgtggttgctgggaaaaaaactgtggctcaaggagcgtttgactcgtctacaacaaggttttctctatttcagtcaaaacatgggcttttatgtttgggaattagacagtgaaaaacaagttttaagactcaaatacctgattcaccaagatctccgaggtaaactccattatcagattaaggaatttccctatggtcacggtagtttactggagatattacgttttccctataagaaacaaaaaatatctcattttacagtttctcaggacaaggacatctgtcgttatatccggcaacaactgtactatcaaaatcccatttggatgaaagaacaagcagaagcctataaaaagggagaaaatctcctgacttatgggctaaaagaatggtatccacaaattcgaccactagtaggtaatttttgccaaattgagcaagatttgattcgctattatctgtattttcaaacctattatcaagaaaatcctcaaaatgattggcaaatgctctatccaccagccttttatcagcaatatttcttaaaaaatatggtagaatagaaaggatggaggaatctaatggtattacaaagacatgaaataaatgaaaaagatacatgggatctatcaacgatctacccaactgaccaggcttgggaagaagccttaaaagatataacagaacaattggagacagtagcccagtatgaaggccatctcctggatagtgcggatagtctactcgaaattactgaattttctcttgaaatggaacgccaaatggagaagctttacgtttatgctcatatgaagaatgaccaagacacacgtgaagccaagtaccaagagtactatgccaaggccatgactctctatagccagctagaccaagccttttcattctatgaacctgaatttatggagattagtgaagagcagtatgctgactttttagaagctcagccaaaattgcaggtttatcaacactattttgacaagcttttgcaaggcaaggatcacgttctttcacaacgcgaagaagaattattggctggagctggggaaatctttggttcggcaagtgaaaccttcgctatcttggacaatgcggatattgtgttcccttatgttcttgacgatgatggtaaggaagttcagctatctcatgggacttacacacgtttgatggagtctaaaaatcgtgaggttcgtcgtggtgcctatcaagccctttatgcgacttatcaacaattccaacacacctatgccaaaaccttgcaaaccaatgttaaggtgcaaaactaccgtgccaaagttcgcaactacaagagcgctcgtcatgcagccctagcagccaattttgttccagagagtgtttatgacaatttggtagcagcagttcgcaagcatttgccactcttgcatcgctatcttaaccttcgttcaaaaatcctgggaatttcagacctcaagatgtacgatgtctacacaccactttcttctgttgaatacagttttacctaccgagaagccttgaaaaaggcagaagatgccttggcagtcttgggtgaggattacttgagccgtgtcaaacgtgccttcagcgagcgttggattgatgtttacgaaaaccaaggcaagcgttcaggtgcttactctggtggttcttacgataccaatgcctttatgctacttaattggcaggacaatttagacaatctctttacccttgttcatgaaacaggtcacagtatgcattcaagctatactcgtgaaacgcagccttatgtttacggagattattctatcttcttggctgagattgcatcaactaccaatgaaaatatcttgacggagaaattattggaagaagtggaagatgatgcaacgcgctttgctattctcaataacttcctagatggtttccgtgggacagttttccgtcaaactcaatttgctgagtttgaacacgcgattcaccaagcggaccaaaatggagaagtcttgacaagtgatttcctaaataaactctacgcagacttgaaccaagagtattatggtttgagtaaggaagacaatcctgaaatccaatacgagtgggctcgcattccacacttctactataactactatgtataccaatattcaactggctttgcagcagcctcagccttggctgaaaagattgtccatggtaatcaagaagaccgtgaccgctatatcgactatctcaaggcaggtaagtctgactatccacttaatgtcatgagaaaagctggagttgatatggagaaggaagactacctcaacgatgcctttgcagtctttgaacgtcgtttaaatgagtttgaagcacttgttgaaaaattgggaatggcataagatggttgaatcatatagtaaaaatgccaaccataacatgcgtcgccctgtcgtcaaggaagaaattgtagacttgatgcgtcagcgccaaaagcaggtcacaggatctttgaaagaattggaagactttgcccgcaaggaaaatattcccattattccccatgaaacggttgcttatttccgttttctcatggaaaccatacaacctaaaaacattctagaaattgggacggccatcgggttttcagccctcttgatggcagaacatgcgccaaaggcaaagattacaaccattgaccgcaatccagagatgattggatttgccaagaaaaatttcgcccagtttgacagtcgcaagcaaattacgctcctagaaggagatgcggtagatgtcttatctaccttgacagagtcctatgatttcgtctttatggattcagccaagtctaaatacatcgtctttctgccagaaatcctcaaacatttggaagtcggtggtgtggttgttttggatgatattttccaaggtggtgatgttgccaaggatattatggaagtccgtcgtggtcagcgaactatttacagaggacttcaaagactatttgatgcaaccttagacaatccaggactcaccgcaacattagtacctctgggggacggtattctcatgcttcgtaaaaatgtagcagatgttcaattgcctgacagcgaatgattttcagaaaaatttaagaaaatatagtaaaatagatagggtaacacttatctcaaaggagtagacatgaagaaaaaactattggcaggtgccattacactattatcagtagcaactttagcagcttgttcgaaaggttcagaaggggcagaccttatcagcatgaaaggggatgtcatcacagaacatcaattttatgagcaagtgaaaagcaacccttcagcacaacaagtcttgttgaacatgaccatccaaaaagtatttgagaagcaatatggctcagaagtagatgacaaagaagtcaacgatactattgccgaagaagagaaacaatatggtgagaactaccaacgtgtcttatcgcaagcaggaatgactcttgaaacacgtaaagctcaaattcgtacaagtaaattggttgagttggcagttaagaaagcagcagaagctgaattgacagatgatgcttacaagaaggcttatgacgagtacactccagatgtaacggctcaaatcattcgtcttgataatgaggataaagcgaaagaagtcctcgaaaaagccaaagctagtgatgcagactttgctcaattagccaaagataattcaacagatgagaaaactaaagcgaatggtggagaaatcacctttgattctgcttcaacagaagtaccagatcaagttaagaaagcagcttttgcgttagatgtaaacggtgtttctgatgtgattagtgttactggaacacaagcatacagcagccaatattacattgttaaactgattaagaaaacagaaaaatcatctaatattgacgattacaaagaaaaattaaaaactgttatcttaactcaaaaacaaaacgacgcatcatttgttcaaagtattatcggaaaagaattgcaagcagccaatatcaaggttaaagatcaagcattccaaaatatcttcactcaatacatcggtggtggagattcaagctcaagcagttcttcaaaagaataaaacagaaaagagccaagtgctctttttcttatgaaaaaatcttctatcttaagggtaagagtttttttctttcggaaaaaatggtataatagcaatcaaaactagaaaataaacggaatttgggaataatttcttttgttctcattagattggtgatactatgaagattagtaagaggcacctattaaactattctattctagttccttacttacttttatctattttgggtttgattgtagtctattctacaaccagtgccattcttatcgaagaaggtaaaagtgccctccaattggttcgaagtcagggaatgttttggatatttagtttaatattgattgccttgatatataagctgaaactgaattttttaagaaaagaacgactcttatttattgttatgtttgttgagctgattcttttggctctggctcgcttaattggtacgccggtcaatggagcctatggttggatttcagtaggacctttgaccattcagccagctgagtatttgaagataatcatcgtctggtacttggcccaacgtttttcaaaacaacaggatgaaattggtatttacgattttcaagttttaactcaaaatcaatggattcctcgtgcttttaatgattggcgctttgtcctcttggtaatgataggaagtttggctatcttcccagatctggggaatgcgactatcctagctctggttgccttgattatgtatacagttagtgggattgctcatcgttggtttatagcctttatcggtgtattggtaggagtttcagccctatccttatcagctatttctatgattggggttgataagttttcaaaagttccagtatttggttacgttgctaagcgtttcagtgcctactttaatccctttgctgatttggcaggagcaggccaccaacttgcaaattcctactttgccatggtaaatggtggttggtttggtctaggcttaggaaattcaatcgaaaaacgtggttatttaccagaggcccatacagactttgttttttcaattgtcattgaagagtttggatttgtgggagccagcttgattttagcacttgtctttttcctgattttacgaattatcctagtcggtattcgtgctaagaatccctttaattccatgatggcgattggggttggggggatgatgctggtacaggtatttgtcaatatcggtggaatttctggcattattccttcgacaggagtaacattccccttcttatcacaagggggaaacagtctcctagtcttgtctgtagccatcgcctttgtcttaaatattgatgcaagtgaaaaacgtgccgaattatatgaggagttagaagctcactcatcaaactatatgtagagttgatagtggaaaggatgacctatgtctcttcaaaaattagaaaactatagtaataaagctgtcgtgcaagaagaagtattgattttaacagaattgttagaagatatcactaaaaatatgcttgcaccagagacttttgaaaaaatcatgcagttgaaagaattgtcaactcaagaagattatcaaggcttgaaccaattggttacgagtctgtcaaatgatgaaatggcttatatttcacgctatttctctatcttgcccctcttgattaatatttcagaagacgtggatttggcttatgaaatcaaccaccaaaataatatcgatcaagattatcttgggaaattatcagcaacaatcaaaatggttgctgaaaaagaaaatgcggttgaaattcttgaacacttgaatgttgtccctgttttgacagcccatccaacacaagtgcaacgtaagagtatgttggatttgaccaaccatatccacaccctcttgcgtaagtatcgtgatgtgaaattaggcttgattaataaggaaaaatggcataatgatctccgtcgttacattgagattatcatgcagacagatatgattcgtagaaaaagaaattgaaagtaaccaatgaaatcacgaatgttatggaatactacaatagttcattcctgaaggcagttcctcatttgactgctgagtacaagcgtctggctaaaaaacatggcttggagttgaaacatcctaaaccaattaccatgggtatgtggattggtggagaccgtgatggtaatccatttgttacagcagataccttgaaacaatctgctatgactcagtgtgaagtcatcatgaactactatgatgaaaagatttaccaactttatcgtgaattctctctctcaaccagtattgtcaatgtaagcaagcaagttagagaaatggctcgtcaatccaaggacaactctatttatcgtgaaaaagagctgtatcgtcgtgccttgtttgatattcaatcaaaaatccaagcaacaaaaacctatctgattgaagataaggaagttggagctcgctatgaaacagctaatgatttttataaggatttaattactattcgtgattccctcttggaaaataagggtgaagcactgatttctggtgattttgttgagttgatccaggcagttgaaatttttggtttctatttggcatctattgacatgcgtcaagattctagtgttcacgaagcctgtgtagctgaactcttgaaatcagcaggtattcattctcattatagtgaactaagtgaagaagaaaaatgccagcttctcttgaaagaattggaagaagatccacgtattctttctgccactcatgttgaaaaatcagaattacttgaaaaagaattagcaatctttaaggcagctcgtaagttgaaagataagttgggagatgatgtcattcgtcagaccatcatttcacatgcaaccagcgtatcagacatgctggaattggctatcttgctaaaagaagtagggctagttgataaagaaagagctcgtgtccaaatcgttcctctctttgaaacaatcgaggacttggatcactcagaagaaaccatgagagagtacctttcacttcctcttgctaagaaatggattgcttcacgtaataactaccaagaaatcatgcttggttactctgatagtaataaagatggtggttacctttcatcatgttggaccctctacaaggctcaacaacaattgactgctattggagatgaatttggcgttaaggttaccttcttccacggccgtggtggtactgtcggtcgtggtggtggaccaacctatgaggccatcacctctcaaccgctcaagtctattaaggatcgtatccgcttgacggagcagggtgaagtaattggaaataaatacggtaataaagacgcagcctactataaccttgaaatgctagtatctgcagccattaaccgtatgattactcagaagaagagcgataccaatacatccaatcgttatgaagctattatggaccaagtggtggaccgtagttacgatatctaccgtgatttggtctttggcaatgaccatttctatgattatttcttcgagtcaagtccaatcaaggctatttcaagctttaacattggttctcgtccagccgctcgtaagactattactgaaatcggtggtttgcgagctattccttgggtattctcatggtcgcaaagtcgcgtcatgttccctggctggtatggggttggttcaagcttcaaggaatttatcgataaaaatccagagaatatcgctatcttacgagacatgtaccaaaactggcctttcttccaatcgcttctttcaaatgtcgacatggtcttgtcaaaatcaaatatgaacattgcttttgaatatgccaaactgtgtgaggatgaagaagtcaaagcaatctatgagactattctaaatgaatggcaagttaccaaggaagtcatcttagctattgaaggttacgatgaactcttggctgaaaatccatatctaaaagcaagtttggattaccgtatgccttactttaatatcctcaactatatccagttggagttgattaaacgtcaacgccgaggagaattatcaagcgatcaagaaaaattaatccatacaaccatcaacggaattgcaacaggattgcgtaattcaggctgatgcctatcaaacttcctcttttctataggggaagtttttgaatctttcaaaaaaatgctaaaagagtcttgacaagtagttgaaaaatgatataatttaaccattcagaaaagtaatcataataaactttttagagagtctgtggtagctgaaaacagataagtgtgatgatgaaaattgggctgaatggtatttagaatttgaaatcataaaaattcggtgagcacaccttacagtgcatctcgttattgcgagacagagcgatagggaaattccctataattgaggtggtaccgcgcatcgacgtcctcacacaagttttttgtgtgaggacttttttgatggaggttagtatggaaagaaaacgatggcgtagcttgttgagataagtgaagtattttaaaggaataaaaggagaaatagaatgaaaaataaacgtttaattggaattatcgctgcattagcagtcttagtagcaggaagcttgatttactcttcaatgaataaaccagaagctaaaaatgaaaagaaagttgccaaagttggtgtccttcaatttgtgagccatccatctcttgatttgatttataaagggattcaagatggactggcagaagaaggctataaagatgatcagttgaaaattgactttatgaactcagaaggtgaccaaagtaaggttgcaacaatgagcaaacagttggttgcaaatgggaatgaccttgtggttggtattgcaacaccagctgctcaaggcttggctagtgccacaaaagacctaccggttatcatggccgctattacagacccaatcggagctaacttggtcaaagatttgaaaaaaccaggtggcaacattacaggggtatctgaccacaacccagctcaacaacaagttgaactcatcaaagctttgacaccaaatgtgaaaacaatcggagccctttactcaagcagcgaagacaattcaaaaacacaggtagaagaatttaaggcttatgctgaaaaagcaggtttgacagtggaaacatttgctgttccttcaacaaatgaaattgcttcaacagtaaatgttatgactagcaaagttgatgctatctgggttccaatcgacaacacaattgcttcagccttctcaactgttgtttcaagtaatcaatccgctaaaaaaccaatttacccaagtgcaactgcaatggtagaagctggtggtttggcatccgttgtagttgaccaacatgaccttggtgtggcaacaggtaaaatgattgcggaagtcttgaaaggtgctaaaccagctgatactccagtcaatgtcttttcaactggtaagtcagtgattaacaaaaaattggcacaagaattaggtattacgattcctgaatctgttctaaaagaagcaggacaagtgattgaataatctacaatggaggagttggggacatctcctccaattttttacaatagaaatcatatagaaaaggttaagaaacagatgatattatctattatttctcaaggatttgtctgggctattttaggtctggggatctttatgacatttaggattttgaactttccagatatgacaacagaaggttccttccctcttgggggagctgttgctgtcactttgataaccaaaggtgtaaatccctttttagcaacacttgttgctgttgcagcaggttgtttggctggaatggcagcaggccttctttatacaaaagggaagatcccaaccttgctctcagggattttggtgatgacttcctgtcactctatcatgctcttgattatgggacgtgcaaatttaggattgcttggaaccaagcaaatccaggatgttttgccttttgattcagatttgaaccaactcttgacaggtctcatctttgtcagtcttgttattgctctcatgctctttttcttggataccaaactcggacaagcctatattgctacaggtgacaatcctgatatggctagaagtttcgggattcatactggacgcatggagctcatgggcttggtcttatcaaatggtgtgattgcccttgcaggggctcttattgcccagcaagaagggtatgccgatgtatctcgaggaatcggggtgatcgttgtggggcttgcaagtttgattattggagaagttatcttcaagagtttgagcttggcagaacgtctggttaccatcgttgtaggttctatcgcttatcaattcttagtgtgggcagttatcgctcttggctttaatacaagttaccttcgtttgtacagtgccgtgattttagcagtctgcctcatgattccaacatttaagcaaacaatcttgaaaggagccaaattaagcaaatgacagcaattgtagaattaaaaaatgcaaccaaagtcgttaaaaatggctttgatgaagaaaagattattttaaatgatgtttccttagaaatttttgaacaggatttcatcacgattttaggtggaaatggagctggtaaatcaactctctttaacactattgcaggaaccttatccttaaccagtggaaccatccgtattttaggtgaagatgttaccaagttttcaccagagaagcgggctaagtatctgtctcgagtcttccaagatcccaagatggggacagctccccgtatgacagtggcagagaatctcttgattgctaagtttcgtggtgaaaagcgtggattgttaccacgacgcttgtctagttataaggatgaatttcaggcaaccattgaaaaagtaggaaacggtcttgagaaacacttgaatacaccgattgagttcttatcaggtggacaaagacaggctttgagtctcttgatggcaaccttgaagcgacctgaattactcctgttagatgagcatactgcagcccttgatccaaagaccagtgtggccttgatggaattgacggatgaatttgtcaagaaagaccagctgacagcgcttatgattacccaccatatggaagatgctctcaaatatggcaatcgtttaattgtcatgaaagaaggacgaattatccaagatttgacccaagaagaaaaagcaaaaatgaaaatctctgattattatcagctctttgaataaagtagggaaaatgagtgaaatggtttactttttttctgaaataaagtatactatataaagtaaactatgataacatggaggtattgtgtatggttgacaaacaagtcattgaagaaatcaaaaacaatgccaacattgtggaagtcataggagatgtgatttctttacaaaaggcaggacggaactatctagggctctgtccttttcatggtgaaaaaacaccttctttcaacgttgttgaggataagcagttttaccactgttttggttgtggccgctcaggtgatgtctttaagttcatcgaggagtaccaagggattccctttatggaggctgtccaaatcttaggtcagcgtgtcgggatagaggtagaaaaaccgctttatagtgaacagaaatcagcttcaccccaccaagctctttatgatatgcacgaagatgctgccaaattttatcatgctattctcatgacaacgaccatgggggaagaggccagaaactacctttatcagcgtggtttgacagatgaagtgctcaagcattttcggattggtttagcacctccagaacgaaactatctctatcaacgtttgtctggtcagtatcgggatgaggatttcctagattcaggactgttttatctctcggatgctaatcaatttgtagatacctttcacaatcggattatgtttcccctgacaaatgaccagggaaaggttattgccttctcaggtcgtatctggcagaaaacggattcacaaacttctaagtataaaaatagccgatcgactgcaatttttaacaaaagttacgaattatatcatatggatagggctaaaaaatcttctggaaaaaccagtgagatttatctgatggaaggattcatggatgtcattgcagcctatcgtgctggaatcgaaaatgctgtggcgtctatgggaacggccttaagtcgtgagcatgttgagcatctaaaaaggttaaccaagaagttggttcttgtttatgatggtgataaggctgggcaagccgcgacattgaaagcgctggacgaaattggtgatatgcctgtgcaaatcgtcagcatgcctgataacttggatccagatgagtatctacaaaaaaatggaccagaagacttggcctatctgttaacgaaaactcgtattagtccgattgagttttacattcatcagtataagcctgaaaacagtgaaaatctgcaggcacagattgagtttattgaaaaaatagctcccttgattgttcaagaaaaatctattactgctcaaaacagctatatacatattttagctgacagtctggcgtcctttgattatgcccagattgagcagattgttaatgagagtcgtcaggcgcaaaggcagaatcgtatggaaggaatttccagaccgacgccaatcactatgcctgtcaccaagcagttatcggctattatgagggcagaagcccatctactttatcgaatgatggaatctccccttgttttgaatgattaccgtttgcgagaagactttgcatttgacactcctgaatttcaggttttatatgacttgcttggccagtatggaaatcttcctccagaagttctagcagagcagccagaggaagttgaaagagcttggtatcaagtcttagctcaggatttgcctgctgagatgtctccgcaggaactaagtgaagtagaaatgactcgaaacaaggctctcttgaatcaggacaatatgagaatcaaaaagagggtgcaggaagctagccatgtaggagatacagacacagccttagaagaattggaacgtttaatttcccaaaagagaagaatggagtaataatggcaacaaaacaaaaagaagtaacaacatttgacgtacaagtagcagaatttatccgtaatcataaacaaaaagggacagcaactgatgatgaaatcaatgctagtctggtgattccttttaccttggatgctgatgggattgaagacctcttgcaacgaattcaggatgcagggatttctatcacagataacgaaggaaatccgagtgcgcgtgttcttagcactgaagaagaaccagaactcagcgatgaggatttgattggttcaacttcggctaaggtcaatgaccctgtccgtatgtacttgaaagaaatcggggtcgttcctcttttgaccaatgaagaggaaaaagaattggcactagcagttgaagctggtgatatcgaagccaaacaacgtcttgcggaagccaaccttcgtttggttgtttctattgctaaacgctatgtcggtcgtggtatgcagttccttgacttgattcaagaagggaacatgggcttgatgaaggcggttgacaagtttgactattctaaaggattcaagttctcaacttacgcaacttggtggattcgtcaggctatcactcgtgctattgcggatcaagctcgtactatccgtatcccagtccacatggttgaaaccattaacaagcttgttcgtgaacagcgtaatctccttcaagaattgggacaagatccgacaccagaacaaatcgctgaacgtatggatatgacacctgataaggttcgtgaaatcttgaagattgcccaagaaccagtatctcttgaaactccaatcggtgaagaggatgatagccaccttggagactttatcgaagatgaagtgattgagaatccagtcgactatacaactcgtatcgtcttgcgtgagcagttggatgaggtcttggatactcttacagaccgtgaagaaaatgttttgcgtctgcgttttgggctagatgatgggaaaatgcgtacccttgaagatgtgggtaaagtctttaacgtgactcgcgagcgtatccgtcagattgaagctaaagctttgagaaaactacgccaaccaagtcgcagcaaaccgcttcgtgattttattgaagactaagagtgaggatgaatatggcttatacagaagagcaaattgaaaatatcaaaacacgaattttatcagccttggaagaagttattgaccctgagttgggaatcgatattgtcaatcttggtttgatctatgagattcgttttgacggcgacacaggacaaacagagattgatatgactttgacaaccatgggttgtcctctagcagaccttttgacagaccagatttatgatgctatgacagaggttccagaagtaacggatactgaggtcaaattggtttggtatccagcctggactgttgaaaaaatgagtcgctatgcacgcattgccctaggcattaagtaaacatataaaacatgtgagagattattggaaaagctaggaaatttcccctcttttccctagtctctcctttcttttgctgattttattcaaagaaaatgatataatagtagttatggaaaaaaagaaattacgcatcaatatgttgagttcaagtgagaaagtagcaggacaaggagtttcaggtgcttaccgtgaattagttcgtcttcttcaccgtgatgccaaggaccaattgattgttacagaaaatcttccaatagaggcagatgtgactcactttcatacaattgatttcccctattatttatcaacattccagaagaaacgctcaggaaggaaaattggttatgtgcacttcttgcctgatacacttgaggggagtttgaaaattccatttttcttaaagggaattgtgaaacgctatgtattttctttttacaaccggatggagcacttggtggtggtcaatccgatgtttatcgaggatttggtggcagctggtattccacgtgaaaaagtgacctatattcctaactttgtaaacaaggaaaaatggcatcctcttccacaggaagaggtagcgagattgcgtacagagctaggtcttagtgacaatcagtttatcgtagtaggtgctggtcaagttcagaaacgtaaaggaattgatgactttatccgtctggctgaggaattgcctcagattacctttatatgggcgggtggtttctcttttggtggtatgacagatggttatgaacgttataagaaaatcatggagaatccccctaaaaatttgatttttccaggtattgtatcgccagagcggatgcgcgaattgtatgccctagcggatcttttcttgttgcctagttataatgagctctttccgatgacgattttagaggctgccagttgtgaagctccgattatgttgcgtgatttagatctttataaggtaattttggagggagattatcgggcgacagcagatagagaagagatgaaagaagctattctggaatatcaagcgaatcctgctgctttaaaagatttgaaagaaaaagctaagaatatttctagagagtattcagaagagcatctgttacaaatctggttggacttttatgagaaacaagccgctttagggagaaagtaaaaagtgaggtaatctatgcgaattggtttatttacagatacctattttcctcaggtttcaggtgttgcgaccagtattcggaccttgaaaacagaacttgaaaagcaggggcacgctgtttttatctttacgacgacagataaggatgtcaatcgttatgaagattggcaaattatccgcattccaagtgttcctttctttgcttttaaggatcgtcgctttgcctatcgaggattcagtaaggcgcttgaaattgctaaacagtatcaactggatattatccatactcagacagaattttctcttggtttgttggggatttggattgcgcgtgaattgaagattcccgttattcatacctatcacacccagtacgaagactatgtacattatattgccaaggggatgttgattcgtcctagtatggtcaagtatctggttagaggttttttgcatgatgtggatggggtgatttgcccgagtgagattgtccgagacttgctatctgactataaagtcaaggttgagaaaagggtcattccaactgggattgaattagctaagtttgagcgtccggaaatcaagcaggaaaatttgacagaactgcgtactaaactaggaattcaagatgatgaaaagatgttgcttagtctttccagaatttcctatgaaaaaaatattcaagcagtactagcagcctttgcagaagttctgaaagaagaagacaaggtcaaactggtggtagctggggatggtccttatctggatgacctcaaagagcaagccaagaaactagagattcaagactacgtcatctttacaggcatgattgctcctagtgagacggctctttactataaggcggcggatttcttcatctcggcatcgacaagtgaaacgcaaggtttgacatacttggaaagcttagccagtggaacgcctgtcattgctcatggaaatccttatctggataatcttatcagtgataaaatgtttggaaccttgtactatggggaacatgatttggctggagctattttggaagccctgattgcaactccagatatggatgagcataccttatcagagaaattgtacgagatttcagctgagaactttggaaaacgagtgcatgagttttatctggatgccattatttcaaataacttccagaaagatttagcaaaagatgatacggtcagtcagcgtatctttaagacagttttgtatctaccgcaacaggtggttgctgtgcctgtaaaaggctctagacgaatgctgagggcttcaaaaacacagttaatcagcatcagagattattggaaagaccatgaagaatagaaagaggaatagctatgaaaaaacaattgatgagaagtggtagtgatcaaaaaattgctggagtatgtgctggggtcgcaaattattttgatattgatccgactattgttcgtgtaatatggggtgttcttgcattttgttatggggcaggaattgtagcttatatcattttatggattattgcgccggtagcaagtgactattgaaaactagctaaattcatgctaagataatagaaaatagaatgtaacgaaggagataaaaatggcatttggagataatggaaaacgtaaaaaaactatgtttgagaaattaaccttgcttatcgtacttatcatgttagtagcaagtattttgggtatttttgcaactgcaattggtgccctcagtaatctataaaatagattcaagaaaattttgtgactgggatttcccagtcccttttttaaagtgagaagaaaaaatgagtatgtttttagatacagccaagatcaaggtcaaggctggtaatggtggcgatggtatggttgcctttcgccgtgaaaaatatgtccctaatggcggtccttggggtggtgacggtggtcgtggaggtaatgtcgtcttcgttgtagacgaaggtctacgtactctcatggatttccgctacaatcgtcatttcaaggctgattctggtgaaaaaggaatgaccaaagggatgcatggtcgtggagctgaggaccttagagttcgagtgccacaaggtacgactgtgcgtgatgctgagacaggcaaggtcttgacagatttgattgaacacggtcaagaatttattgtagcccacggtggtcgtggtggtcgtggaaatatccgctttgcgacaccaaaaaatcctgcaccggaaatctctgaaaatggagaaccaggtcaggaacgtgagttacaattggaactaaaaatcttggctgatgttggtttagttggattcccatctgttgggaaatcaacacttttaagtgttattacctcagctaaacctaaaattggtgcctaccactttacgaccattgtgccaaatctaggtatggttcgtacccaatcaggtgaatcctttgcagtagctgatttaccaggtttgattgaaggggctagtcagggtgtcggtttgggaactcagttcctccgccacattgagcgtacccgtgtcatccttcatattattgatatgtcagctagcgaaggacgtgatccttatgaggattatcttgctattaacaaggagttggagtcatacaatcttcgtctcatggagcgtccacagattatcgtagccaataagatggatatgcctgagagtcaggaaaatcttgaagaattcaagaaaaaattagctgaaaactatgatgaatttgaagagctaccagctatcttcccgatttctggattgaccaagcaaggtctggcaacgctcttggatgctacagctgaattgttagacaagacaccagaattcttgctctacgacgagtcagatatggaagaagaagcttactatggatttgacgaggaagaaaaagcctttgaaattagtcgtgatgacgatgctacatgggtactttctggtgaaaaactgatgaaactctttaatatgaccaactttgatcgtgacgaatcagtcatgaaatttgctcgtcaattacgtggtatgggggttgatgaagcccttcgtgcgcgtggagctaaagatggggatttggtccgcattggtaaatttgagtttgaatttgtagactaggagactgatatgggagataaaccgatatctttccgagatgcggaaggcaacttcgtctccgctgcagacgtttggaatgaaaagaaattggaagaactatttaatcgtctcaatccaaatcgtgctctgagattagcacgaactaaaaaagaaaatccatctcagtaaagaatataacaaaattccgtgccacatgagacacggaattttcttattcttcaaagaaaaatggtggagcgaattttttcaattcttcaaagcatttttgagcagcttctgcatcttcacagatgacgagacagacatcatctccacagagagtagcgatagcgtcagggaagctcaaagcatcaatgatagaaccaaaggattgagcaagtccaggaagggtttttagtaggacttggtgttgaacggggcgcatcaagacaagagcatcctccatataaatttcgagacgtttttcccattttgagatagaacctgtattgagcacgtagtaagagttgtcttcttctcgtacttttgaaaggttcatacttttaatatctctcgaaagtgtagcttgtgtaacttgaatatcattatcggcaagaagagcttgtagctcagcttgagtatgaatcttgtttttcgttacaagagctcgtatgagttggtgtcggtgttcagatttattcataaaatattactccttgtactaggtacagaaagcgtggactgaacgaaagcgtcagtcgggtggtaagcggtattgtcacgtatgatgatttcaaagtcagtagtataggactaaatggagaaaatcccacacttttaacttgtcactagttgggtgtagatgaattgggtatctatctgtttatctacattggtgtcctctactaacagtaaatcattcaattagggtagccttttgtcacgacttgttgtgaatttacgattaatgtcaaatcacagagattttccaacatgtggtgtggtagcgagtgttattaatgagtacacatgttggttagagtcttagtatcttttgtctaagctcccgtgtagacctatcataagcccatattgggattgaagttgataccaagtttatgtttgtttcaactgtttaagtggaaatcttccatattgaaagtctgatatcataccttttgacaaggtaggataaggctagactgttctagatcgacagtcaggtggtaagcggtattgtcacggattgttatttcaaagtcagtagtatagaggactaaacgaagagtatctccttcttttaacttgtaaatagttggttgcaattcaaattggatatccatccattcatcttcagtaatattctctactaacagtaaatcatttctattttgtaaattgaggtagccttttgtcacgatgcgttgtgcattttcacgaaaaggcaattcgttaagattttccaacatgtagtagcgaccgttgtcaatggttctagcacttaatacagctggataaggttgtaggtatttcttctgtccaaattctagcagttgggcagataagagccccttatttgtactggatttgatacgaagattgagttgggcacgaccgttcaggtggagatccttggtcacaggaaggtcaatagtaatctgattgactttcccttgatagagttctgtattgaaggtctggtaagtcttaccataacgctcaaaatccttatctgagtactggttttgaataacttgctcttcttgaccaagtgcgaaggtttcaaagttttcttgcccaccaaagttatcaagtgataaccaagtctgaggagttgtattatcctgccagataacagtaggaagttggtaatccgtttcctgttccagtaatttctttgtcaacaaagcattcatggactcacggaaatcaatggactgccagttattcatataaacatgggcaccattatggaaaaagaggtgcttatttatattatcaggaagggcgtgaaacatctgataaacatgaagtggtttgacattccaatcctgtgaaccatgagtaaagacaacctctgcctttaccttatgggcattaagcagataattgcggtcatgccaaaactgattgtagtcgccagacttgcgatccagttgcacttttactttttctaagtcagcttggtgagactcattgccacggatatagtcaccagccaagagattacgagagtaggttagttcagcaagggagtcaaagtcctcacctggataaccacctgggctagttactagaccgttttcacggtagtagttgtaccacgaagaaataccagcctcggcaatgataacctctaaaccatctacacctgtagtcgcaagaccattggacatggtacctagataggaaagtccagttgtggcaacttttccgtttgaccagtcagccttgacttgacgctggcgcgtatggtcagtaaaggcacggcaacgaccattaagccaatcgataacatttttataagcctctatttgctggtagtccccgttagtcatgaaaccagtagagtctttggtaccaacacctgagacatagagattagcaaaacctcgtggaaggaagtagtcgttgagtgtatagctagagttgatgtgtgttagcttttcctcagcttctgacacaagctcagcttgaccttggagttggacgagatttagttggggttcctctagctcaatcttgtgagcaggcttaacctcaagatagccctccatcttgtaaagagctttatcgctggccttgtcattggttccctgatggtagggactggcagtcatgatagcagggatttgcccatcataacgaggacgaataatgctgaccttgactaggtctggtagacctttttggtcagtatcgacacgagactcaacgtaaacgacttctcgaatggcatcatggctagaaaaagtagccaaactcttgccgttaaagtagtgatagtcattatcctcaggaataagaccgtcgctgacaagttggtcgataagagtgttcccctttttagtgcgagtattgagtaactgatagagattttcaaccaagtcaccatatacaatgggaaaaccagtctctttgcgaaaagcttcgccgtcttcaaagtcaatcaaataagaaaatcctaaaagttgaaaagccacagtatagaaaatatctgcagtcaactctttatctgattgaaaaaatgtcaataagtcagtttctttatcaactgctaaactggatagaggataggagctgtttttaaaattaaaaaagaaacgaataagaaacgcttcaagcatttgtttatttgtaatgttgactggtaaatcaaatccatacttttttaattcaaagataattgtatctctaggtagtgctaaatagctgaattgattaaaacgcataagacctccaataaaattttacttaagattattatatcaaaaataatgcctaaaaaccaagattaatctttctgtagaaagatatttaccattatatattacaacagtttaatttttaaaaacgaaagaaaattccattatcaaatgatatagaaaatgttcaaattctttgaaatgaatacgattgcatggtataatatatcgtatgtaattgtaaaatttagttacataaaaaatataggaagtgaacattatgtataaatcaaaaagacaaaaaaataagtcttttgattggtatggcttgagccaacgtttctctattcgtaagtatcattttggtgctgcgagtgtgctgttggggacagccttgattttgggtgctgcccaaacgactgccaaggcagaagaaacagctactgaaaataaaacagaagctgttgcatctgctccaaaagatgataaggcaggtgagaatgtcgcaaatgtgacgacaccagctctttctgctacgacagaagcggctgtaatagaaaagccaaccttgagtgatgaggaagttgcaaaattagctgctgaagcatctaagaaagatgataaagcagctgaaacagctacaactgaaaaaacagaagcagctgacaaagaaaaagcaacactaactgctccttcaacagacaaaaaagctgataaagcagttgatgaaaaagctgataaaaaggacgaaaagaaagcagaaaacccaattactgctactaaaactgtccttgaacagttgacatctgaagcagaagtattgaacacaactgcctcaaactttgcgaataaaaaggcagaagataaagctggaaaagaagcaatcgcaactgcagttgcttcagctaaaattcaaatcgaagcttctaagaaagctcttgctgctggagaaatcactaagcaagaattggatgcccaactccaacgtatctcatctgccatcgaagcagtctatgctgagatgaagcgtgcaggacatgtaggtaaagttgaagcagtattggcggatggagcaggttctacagtagctattgctaatcctattaacaaagttgttgttaacaatgttggcgatattaccgaagaagaagcgcgtgccattgaaaaagaaatccgtactgcaaatccatccttgacagctgaagataaaatcgaagttaaacgaaaaggtaatacaggtgctgccgtagcaactgtaacattggctaatggtaaggtagatcaaaatggtagtaaaacatataattttgctattggtgatgtagcttatggttcagctggtgaaaaaaactatagtcaactccgtgaagcaatcaactggtttgacttcgctactgcgtctattacatatgctgatggaacaaaagtaggtgctgttgaatatgttaataatccagctatggttgatttcacgagctctaaaggacgtcaagaacgcggccgttttacaatggttcgtacagttcttgaatctacaactcatccagagttagtaggtaagaaaacaaatgatccggcatttttagcgtctggattagctaaatatacattgtggaaaacatatgatcatgtgaaacatgaagtgcaacaaggtctatctgaaggacgatttaataatgaaatatttgaggttcttcaagaaggaatgcgtttcgatgtaccaactaaggtaaaaggttatacattaagtgcaacagtaagttccctttctcgtaaaaaagttaccacagaaacatatactttaaataaagctaatggtgaacctgaaaatatcaacagaagccctgttgatggtgttgttcaacgtgaagacgtcattgtaacaagacaagatccgaactggagtcatttacgattagcaggatttgaaactaaatatgaagattcaaacggggtaactcgtgaacgattaactgcctttgctccagcttatgatggtggtaacgttggggttaagttccaattatcagcaacatataatggacgcccagtcgcggttaatgcgattgcagttgattcagaagatttaggtgcggcagaatttactcagttcgaatctgatggaacaccttgggaagagttcatgcgtttgaataaaaacaaaacggcttctaaaggtttattccctaatagaaatattaactctaactttacatatactttcgatagaaaaacaaatgcaaggttatcaacaggttataatctttctgagtgggcgaataaaacggaaacaggttatggaagccaattgttcggacctttcaattcaggtattaatgatggttatgatcttcctataggtcttactcaaaatgttgagaacttaggagtttacattaatgccaatggtagccaatcagcaacagtaggtttcgttatttatgatggtggggatgcaccagcctcttatggttcagcacaacacatcattggtaactttaataaagataagaatggaacgcaagtaactgcgacacaaccatatttaggagatgttcctgcagatacagacttccgtacaacaatcactgagccgaatggagcttgggtacttgatgacttagtgaactcagaagattataaagaaatcagtcttgttagcggttcaacgcaagttacaaactctaaaggtcaatcaggaacatacttattagatggtaaaaaccctgtaattcgtatggctgatggaacgcaagtagcgattaaaaatggtgaaattctatcaacagctaatacattacaaggtggagatggtttaccaattaaaggattgtataaccaagctacacgtggacttggtgtagggaatctaccagatgaaggagaaggacaacttcttgatccagcagttgcgactaagtacacactacgtcatgcaagtgaaaatgaatatatcttaaaaggtgtcaaagttaaccgtggtgtcaataatgatgtagcctatgttcgtggatgggttgactttaacggtaacggtaaattcgatctttatgaatcatctgaattagtaacagctaatgctgatggaacatatgatatcaccttcaaaaatacacctcaattattaaacacatcagtagataatcttggtgttcgtttacgtgtttctgtagacaaaaacgacttaagattaccaacaggattagcgtcttcaggggaagtagaagactttgttgcgaacgttattcacccacctcgtggaacacgtcatgaaacaaaagattttcaagggaaaaaacaagaagtgaatttccctaccaacgctatgttcaaggctagtggtaaaacaattgaatctaactataaacaatgggcggaaattgataataatacggcgcctaagatggtgttaaatgatacggttgttaaatctgaagaaccaactggtaagactgttgaagtaaaagaccacttaagccaaacaatctataacggtacggaagttgttgttaaagatgcaagaggaaatactcttggtacagctgttaaagtaacgaataaattgacaggtaagactgaatattacttatctgaatatactgaatatgatacagctgggaataaagttggggtttataaactaaatgaaggttctgcagaaggtaagaatactacacaaggttctctaagctttactaagattagttttcaaccagaagcaggatttgtaggtacagctaaaggggtagctatccgcgcgtgggatgataatggaagtcacactggatgggaagctacagaagatacaattaaagaatctctaacaagtacgactctagctgaaaaagataaagtattagaaaatgtaaacaatggaaataacggtgccaaatcaatggatactagttatattccaacggtaatcgacgttcgtccagtaggagaagatactactactgaggatgttcaaggtgctgttcaaaaatctaatccaactatcccagtttatggaactgttgaaactgttacgaatgataaagtagaagacgttaagtatacagctgattatgtaatactagataaaactaagaaaccaacttttgcaactagaaaagaaacaccagggaaattatatacagaagatacaaaagttgataaggaaacaactgttacactaacagatggaacaacagtcacttataaaccagcagataaaattccggcaggaactacaatagcgaatactggtgatgtgaatgttacaggaacaggaaatgtcactgtaaataacattcgattagtttcaggtactacgatccctgctggtgcaaaacctcaaagcaatcacccagcaccagtggaagtaaaagtaacattagcgaatggaacagagcaaacaattccagcgggaggaacaattccagcaggagctactatcaatacgccatttactaattcagctaataatacattcgacaatgtaacttataatactggacaaacaattccgcgtgaaaccggaaataagatttcaactttagccaaggaaacatcagcagatcagttagttccaaaaggtgaaagtattacacttaatggaacaacttacaacgcaaataatgatgtgattccaaaaggaactcgtactgctgcgacatatgaagacttaatgaacgtaactcttccaaatgcagttcacatcgatccacaaacaggagaagtgacaagtgttccacgtcgttacactaaagtaactgatacagaaatcgtaattgaaaacgaaggtacttacacattaaaccaagatactggtgaaattactttcacaccagatcctaagttcgtaggaactggtactggtgtagtaaaacaacaaccagatgttgactataacgataaagtagctggggacccagtaacaagtaaatatggtacagactttggtaaagcaacttatacaccaatcgttaagccacagtcaaaagcttcaatcactcgtacaattcattatgtatatgaagatgctaatgataatccagcaagtcaagattcatataaagataatgctccaatcgtagcaatcgataatacaccagttactcgtacacaaacgatcgactatactcgtgaatacaagattttctctgaagcgggaactactgataaggcaatcacaactgcgaaccaagttacagatgcaactgggcatgtttataaagttggagatactatcccagcaggaacacagttcaatcaaggttcaattatcatcggtaaatggactgcttcaagtgatgcaaactctaaatttaaagaaattatctcaccaacagttaagggatacactgctgaagtagtaacagctaacttcacaccaaatgctgatggtaagatgggacacatccacaatggtaaacaacctgttggattgtatactccagtagctgacaatactagagatgttggtgcatacgaaccattagtatcagaagttcgttcagacgacaaagatgacttcgatatgtatgttgtttacaaagctgatattcaaaaagctaaagtaacatatatcgatttagatgcaacaggtgatgctcgtattcttgaagttcaaaacgctaatccagctcctgtaacaggtgcagatgcgaaaacaacttatggtgttacaacgcttcaaggtaaatctcatacgaagattccttatacaacagctgaaacaatcaaaaaatatgaagaccaaggttatgaattagtaacagatgactatacaaataactctcaaggtacagctgtagaaggtggacgtaagtttgatgatgataaagaagtagatcaagcattcaatgtctacctacgtcacaagaaagttactcgtaaaattaaagatacccaagaagtgacacgtacaatcgagtacaaatatgcaagtacagatgatgtaccagcagataaacgtggaacaacagcagcaccaacagtgactgaaacacttcactatgaacgtgaccgtacaatcgattacacattagctgcaaaagaatatccaacagaatacgctacttataaggctgtattggataagagtggatatgattctccagaagaatacaaagctcgtacagtttactacgatcacatcacaaacaaagcaattgcagcagatgcaacagctgctcaaaaatcaatcgttacatttggaccatggactccagtaggtggaacatctaacgatgcgattacattatctgatgcagaaaaagctaaagatgataaattcaaccttgttaactctccagaagtaactggttatgttccagataacgctaccgtagaagcgactgcagcaatcgatgcagaagcggatgactacaagattacagttctttatactccagtggaacaaaaagctgtagttaaattcgtagaagtagatcctactaatacagataaagtcattactccaggtcttgcagattcaatcgcagtaacaggtaaatctgaagctacttacccagctacaacagcaacttcagtaacagataagattgctgagctagttaagaaaggttacgaactagtaaataacggatttgtatcaacagataaattcgataaagatgctgcagttgatcaagaatatgttgtgaaattcaaagctaaagtagtagatgttccatcatttgatccaactaaaccatcaagtgacgacaatccaaaaccaactccaggtgtaacgccaatcgatccaaataatccagatggaccaaaatggaccgaagcattaatcaacgctgtaaaagtacaagaagaagtaacacgtactattaagtatgtatacgaagatggtactccagtagcagaatctgatttaacaagtgtggctgataagaaagttaaaacacttaaattcacacgttctggtaagattaatgtagcgacaggagaaatcacatacggagattggtcggctgatcaaacattcgaagcagtaacttctccaacacttgagaaatacactgcggcagttgcaggtgtaacaccaacagttgcagatgtgccagcgaaaactgtagcggctacagataaagactttgaagagacagtaatctactctacaaaaccaacaactgtagatcctaacaaaccaacagatccaacaaatccaaatgttactccacaacctgatgatgtagttcctaacgatccaaaaggacgtacatacagagaactaggtttagttgaagaagtaacacacacagttcactacaaacttgaagacggttcagatgcaggtatcgctgataatgtacaaacattaacatttacacgtaccgcagaggtagatccagtaacaggagcaatctctaactacggtacatggaaagctaaaggtggagatacaacaattgatgctgtaacaacaccaaataaagatggatacgtggcttcagcaaaaacatctacagaacgtacaaatgtatcagctacggataaagatagtgaagaaacaattatctaccgtaaacttggttcatatgtaccagtagtaccagaaggcatcacacctccggcagatgctgacctaaatccaaaaccatatccaaatgcaactccagcagatcctacaaaaccagggacacctactgaaactccagtagttccatacattcctggaacaacaccggtaggaccaaatggaaaaccattaacaccgaaagatcctaacgatccaagcaaaggatatgaagtaccagacttaccaacagatccaacagagaacactacaattacctatgttaaagatggatcacaagtagcgattgttcacttcatcgaagtaaacagtgaaacggataagactgaaaaaggtgcagttgcagaatcagtagtagatactggtgatacaggaaaagcattcactaaagctgcagatgtaacagcaacaattgaagcactaaaagctaaaggttatacagttgtagaaaacaactacccaacagatggtacattcgatgcagattctaagactaaccaagtatacaaagtcctagtaactgctaagccaattactgtaaatccaaacgacccaactccaactaaagatcaaccaatcgatccaaataatccaacaggaccaaaatggactccagagttaatcaaagagttagaagacggacgtaaagaggaagtgaaacgtacaatcaagtatgtttacgcagatggttcaaaggctgctgattcagtacaagaaactaaagagttcaaacgttcagcaactatcaatccagtaactggtaaggttacattcggagaatggtcaccagctcaaacatttgaagctgtaacttcaccaaaagttacaaacttcactccagataaagagactgtaccagcgacagaagtaacagcaactgctgaggatattactgaaacagtaatctatactaccaaaccagcaaatatcgatccaagtaagccagtagatccaaatactccaaatgttactcctaaacctgaagacaaagtaccaaacgatccaaaaggacgtacttacaaagaattaggattaatcgaagaagtaacacacacagttcactacaaactagctgacggatcagatgcaggtatccctgacaatgtacaaacattaacattcactcgtacagctgacttagatccagtaacaggagcaatctctaactttggtacatggacagctaaagacaatgatacaacaatcgacgctgtaacaactccaaacaaaccaggatatgtagcttcagcagctaaatctacagagcgtacagaggttaaagctactgataaagatagcgaagaaacaatcatctaccgcaaacttggttcatatgtgccagtaattccagaaggagtaacacctccagcggatgctgacttaacaccaaaaccatatgaagatccaaccagtgaagatcctacaaaaccaggaacacctactgaaactccagtagtaccatacatccctggaacaacaccagtaggtccaaacggtaaaccattaactccgaaagatcctaacgatccaacgaaaggatatgaagtaccgaaacagccagaagatccaactcaaaacactacaattacgtatgttaaagatggttctcaagtagctctagttcacttcattaaagaggatggtactgcagttcacgtatcagttgcggaagcaggagatacaggtaaagcaatcaagacaacaaacattgataacgttaaagctgaattagaagctaaaggttatgaagttgttgctccaactgatgcagcttatacagcagaacgtgtagcattctacgcagaagctaaccgtacatttgatgacaaggatgacaaaggtaatgatggaattagtcaagtttactatgtaatcgttaaagagggaatcaatccaatcgatccagataaaccgctagatccaaacaatccaaatacaactccaaaaccaggagacaaagtacctggagatccaaaacaacgtacatacgaacaactaggattactagatgaagtaaatcgtacaatcaactacagatatgcgaatactgataaagtagaagaagctaaacgtggtcaagaagctgcagctactgtagaacaaaaacttcgttactctcgtaaaggtgacctaaacaaagtaacaggtgaaatcacttatacttctgattggacagcaccacaaacattagcagaagtaacttctccagttatcgaaggatatgttgcggacattaaagcagctgaaaaagtagagaacgttgctcatgatgcagctgattcagtagtgaacgttgtttactcaccactaggtaaatatgtaccaaaagtaccagaaggattcgaagttccaaaagttgagaaacctcaatatccaaatgatccaacagatccaactaaaccaggaacaccaacaacagtgattcctcatgttccaggaacaactccaaaagatccaaatggaaatccactgaaaccagtagatccaaatgatccaagtaaaggatatgttccaccaacacctgaaaatccaacagaagatacgcaaatcacttatgagaaagatactcaaaaagcgaaagtaacttatgtggtagaaggaacaggaacagtacttcacacagataacctaaaaggtaaatctggagacccaatcgagtactcaacagtagctaaacttgctgaattgaaagctctaggatatgacttagtaagtgacggattcacaactgctacagataagaactacgataaagatacgaaagtagatcaaagctttgtagtaacagttaaaccacacgttgagccaatcaaaccagtagatccagaaaatccaaatgatccaaataaaccaaaaccgggtgatccaatcgatcctaagaaccctgatggaccaaaatggactgaagatctaatcaagaagattgatacaactcgccacgtgaaccgtacaattaagtatgttaacgaaaaaggtgaggaagtagctaagaaagtaactgataaagttacattcaatcgtgaagctaagatcaattcagtaacaggtgaaatcacttacggtaactggacagctaaagatggagatacaacattcgataaagttgaatcaccagtcgttaacggatacatcctgaaagatgccaaacaaaaagaagtagcagctacaacaggattaactgcagactctaaagatgaaaacatcgaagtagtttacactaaacttggttcatgggtaccgaaagtaccagaaggtgaaacaccaattgatccacttccatatccaaatgatccgaacgatccaactaaaccaggaaacgatagaccaatcgttccttacgtaccaggaactacaccaaaagatccaaatggaaacccactgaaaccagtagatccaaacgatccaagtaaaggatatgttccaccaacacctgaaaccccaacagaagatactgaaatcacttatgagaaagatactcagaaagcaaaagtaacttatgtggtagaaggaactggaacagtacttcacacagataacctagaaggtaaatctggagaaccaatcgactacagtacagtagctaaacttgctgaattgaaagctctaggatatgacttagtgagtgacggattcacaactgctacagataagaactacgataaagatacgaaagtagatcaaagcttcgtagttacagttaaaccacacgttgagccaatcaaaccagtagatccagaaaatccaaatgatccaaataaaccaaaaccaggtgaaccaatcgatcctaagaaccctgatggaccaaaatggactgaagatctaatcaagaagattgatacaactcgccacgtgaaccgtacaatcacatacgttaacgaaaaaggtgaggaagtggctaagaaagtaacagataaagttacattcactcgtgaagctaagattaactctgtaacaggtgagatcacatacggtaactggacagctaaagatggagatacaacattcgataaagttgaatcaccagtcgttaaaggctacatcctgaaagatgccaaacaaaaagaagtagcagctacaacaggattaactgcagactctaaagatgaaaatatcgaagttgtctacactaaacttggttcatggattccaaaagtaccagaaggttctacaccagttcctccggttacgtatccaaacgatccaaaagatccaactaaacctggaactgataaacctaaagtgccttatatcccaggaactacaccggtggtgccaaaagatccaactaaaccaattagtccggataacccactagttccattaacaccagtagatccaaacgatccaactaaaggatatgaagtaccaccagtaccaacagatccaggaactgatacgccaatcacttacgtaactgataaacaaaaagctatcactaacttcgtagatagaaaaaggtaaagtagtatcaactccagtaattgatgaaggtgattcaggagctaacttcactaagtctaaagttgatgaagtaactaagactattgaaaaatttgaaaaagctggttatagagtcgttaagaacgagttcccatctaaagatacagatagagtatttgataaagataaatctgtagatcaaatcttcactgtaacagtagctgaaagaattattccagttacaccaggtaaaccaatagatccaactgatccaaacttaccgaagaatccagatggaacacctgtgacaccatctacaccagaaccaggtaaaccagtattccctaacgatccaaacagcccagtatggccaaatactgtgaaagatcttgtaactgagaaatcagctacacgtacgatcaagtatgtagatcgcaacggaaaagaagtttctgaaactcgtgttgaaacaatcaagttcactcgtgaagcaaaagttaacttagtaactggtgaaattacatatggtgagtggacaacagatcgtaacgatgatatcttcaacggttaccaagtaccagttgtgaaaggatacatcgctaaagctggtgatctagaatcatcaactaaagatgtacaagtaactcctgatacaatcaaggatatcaatgaaacagtgatttacgataagttaggttcatggattccaaatatcccaggaacaccaacaaatccaatcacatatccaaacgatcctaaagatccaactaaaccaggaacagataaacctaaagtaccttatgtaccaggatttatccctgtagacccagaaggtcaaccattgaaaccagttgatccaaaggatccaacgaaaggatacgaagtaccagaggtacctggtgatccaacgcaagatacaccaatcaactacattcctaaggatcctacaccaaatccaactccatacccaggtccaactccagctccaactcctaaaccagagcctaagccggaaccaaaacctgagccaaaaccagaaccagaaactccacaacctgtaacacctgcagataatggagataacaatggaaataataatggaactccaacaactccagctcaaccagtagcgccttctacacctcaatacatggatggtcaacgtgaacttccaaatacaggtacagaagatcatgctagccttgcagcacttggacttctaggagccctaagtggatttggattgattgctcgtaagaaaagagaagatgaagaataatcattttgattttcattaaatgctaacttgcaaaaagataaagaaagaacttgagatttactatctcaggttcttttctttctctttttgaaaatggtataatatagtgagaacgatagaggagaagtgtaaattgatcgcacaactagatacaaaaacagtctatagttttatggagagtgtcatttcaatcgacaagtatgtgagagcagctaaagaattcggctacactcatctggctatgatggatattgacaatctttatggggctttcgactttctagaggttacaaaaaaatacggcattcatcctttgttagggcttgaaatgaatgtgattgtagatgataaggatgtgaatctgcgctttttagctttatctagtgtgggctatcagcagttgatgaaactttcaacagccaagatgcagggggagaaaagttggtcagttctatctcagtatctagaggatattgtggtaattgtgccttattttgaagagcttgagttgttaaatctaggctgtgattactatataggggtttacccagaaacactggccagcgaatttcaccatcctattttaccattgtatcgggtcaatacatttgaaagtaaggatagagaagttcttcaagtattaacagcgattaaagaaaatctaccgctcagagaagtccctttgcgttcgaaacaagatgtttttatatcagcaagttctttagagaaactattccaagaacgttttccgcaagccttggacaatttagaaaagcttatttcaggcatctcttatgacttggatactagtctgaaattgcctcgctttaatccagctagaccagcagtagaagagttgagagaacgtgctgaattggggcttgctcagaaggggttaactggtaaagaatatcaagaccgtctagaccaagaattggctgttattcatgatatgggctttgatgattatttcttggttgtctgggatttgttgcgttttggacgttcgaatggctattatatgggaatgggacgaggttccgcagttggtagcttggtttcctatgctttagacattacagggattgacccagtagagaaaaatctgatttttgaacgtttcctcaatcgtgaacgctatactatgcctgatattgatattgatatcccagatatttatcgtccagattttatcagatatgttggtaataaatacggcagtaaacatgcggctcaaatcgttactttttcaacctttggtgctaaacaagctttgcgagatgtcttgaagcgctttggtgttccagagtatgaattatctgcaattaccaagaaaatcagttttcgtgataatctcaagtcggcctatgagggtaacctccagtttcgtcagcaaatcaatagtaagttagaataccaaaaagcttttgaaattgcctgcaagattgagggatatccaagacaaacctctgtccatgcggctggtgttgtgatcagtgaccaagatttgactaactacatccctctaaagcatggtgacgaaattccactgactcagtatgatgctcatggagttgaagcaagtggacttttgaaaatggattttctggggctacgaaatttgacctttgtccagaagatgcaagaattgcttgctgaaacagaagatattcacttgaaaattgaagaaatcgatttggaagataaagaaacgctagctctttttgcttctggcaatacaaaaggtatctttcaatttgagcaacctggtgccattcggctacttaagcgtgttcaaccagtctgttttgaagatgtagtagcaactacttccctaaatcgaccaggtgctagtgattatatcaataattttgtagctagaaagcatgggcaggaagaagtgacggttctggatccagtgctggaggatattttggctccaacttatggcattatgctctatcaggaacaggttatgcaggttgctcagcgatttgctggatttagtcttgggaaggctgatattttgcgtcgagctatgggtaaaaaggatgccactgccatgcatgagatgagggcttcctttattcaaggctccatagaagctggtcatactgcggaaaaagcagagcaggtttttgatgttatggagaagtttgcaggttatggatttaatagatctcacgcctatgcctactcagccttggccttccagttggcttattttaaaacacattatccagctatcttttatcagattatgttgaattctgccaacagtgattatgtaacagatgccttggaagcaggttttgaagtagccccattgtccattaatactattccctatcacgataaaattgcgaacaagtctatctatctaggtttgaaatcgattaaggggctcagcaaggatttggctatttggattattgaacatagaccttattctaatattgaagattttttagctaaactacctgagaattatttgaaacttcccttgctggaacctttggtaaaagttggtcttttcgattcatttgaaaaaaatcgtaaaaaagtattcaataatttagttaatctatttgaatttgtgaaagtattaggaagcttatttggagagactatctatagttggcaagattcggaggactggacggagcaagaaaaattctacatggaacaagagctcctaggagtaggcgtcagcaaacatcctctacaagctattgcaagtaaggctatttatccgattactcctattagtaatttgtcagaaaatagctatgctattatcttggttgaagttcagaagataaaagtaattcgtaccaaaaaaggtgaaaatatggctttcttacaggtggatgacagtaagaaaaaattggatgttaccctcttttcagatttatatcgacaggttgctcaggaagtaagagaaggagccttctactatattaaagggaaagtccagtcacgtgacggtcgtctgcaaatgattgcacaagaaataagagaagcagtggctgagcgcttttggattcaggtgaaaaatcatgactcggatcaagaaatgtcacgtattttagaccagtataaaggcccaatcccagtcattatcaggtatgaagaggaacagagaacaattgtttctccccatcattttgtagctaaatctgatgaattagaagcgaaattgaatggaatagttatgaaaacgatttatcgctaaaattacggaaaatagaagaattttcaacgtaaatgtggtataatcagtaagaatgttaaaagaaaaaggagcataaccaatatgaaacgtattgctgttttgactagtggtggagacgcccctggtatgaacgctgccatccgcgcagttgttcgtcaagcaatttcagaaggaatggaagtgtttggtatctatgatggatatgctggtatggttgccggtgaaattcatcccctagatgcagcttcagtaggggacatcatttctcgtggtggtactttccttcactcagctcgctacccagagttcgctcaacttgaagggcaacttaaagggattgagcaattgaaaaaacacgggattgaaggtgtagttgttattggtggtgacggatcttaccacggtgctatgcgtttgactgaacatggcttcccagctatcggtcttccaggtacaatcgataacgatatcgttggtactgactttacaatcggttttgacacagcggttacgactgctatggacgctatcgataagattcgtgatacgtcatcaagtcaccgtcgtacttttgttatcgaagttatgggacgtaacgcaggtgatatcgctctttgggcaggtatcgcaactggtgctgatgaaatcatcattcctgaagaaggcttcaagattgaagatatcgtagaaagcattaaatgtggttatgagtgtggtaaaaaacacaacatcatcgtcttggcagaaggtgttatgtcagcagctgaatttggtcaaaaactaaaagaagctggggatacaagcgaccttcgtgtgacagaacttggacatattcaacgtggtggttctccaactgcgcgtgaccgtgttttggcatcacgtatgggtgcacatgctgttaaacttcttaaagaaggtatcggtggtgttgcggttggtatccgtaacgagaaaatggttgaaaaccctattcttggaactgcagaagaaggagcattgtttagccttactgcagatggtaagattgtggttaacaacccacacaaggctgaccttgagctatctagcttgaataagagcttgtcataatttataatttagttaataagaccaaaaaggtcatatataaaggagtcacaaaaatcatgaataaacgtgtaaaaatcgttgcaactttgggacctgcggtagaaatccgtggtggtaaaaaatttggtgatgacggatactggggtgaaaaacttgatgttgaagcttcagctaaaaacattgccaaattgattgaagctggtgctaacacattccgtttcaacttctcacacggtgaccaccaagaacaaggtgagcgtatggcaactgttaaacttgcagaaaaacttgcagg

SEQ ID NO: 62 - DNA, 111153 bp, Streptococcus mitis NCTC 12261 contig8
ctagtttttgatttcttctattttaccacattttgccgtttaaagcttaagaaaattatgatatactagaatgtagcaaaaatttagaaatggacgtgaagcaagaaacatggcacagttgtactatcgttatgggaccatgaactctggtaagacaatcgagattcttaaagtagcctataactatgaggagcaaggaaaaggtgttgtgattatgacctcagctcttgatacgcgtgacggtgttggctatgtgtcgagtcgaatcggtatgaaacgccctgccattgcgattgaggaaacaactgatatcttcggttatatccgagatttaccagaaaaaccttactgtgtgttggttgatgaagcccagtttctcaagcgtcatcatgtttatgacctagctcgtgttgttgatgagttagatatacccgtcatggcttttggtttgaagaatgactttcgcaatgagttgttcgaaggttcaaaatacctcttgctcttagcagacaagattgaagaaatcaagaccatctgtcagtactgtaagaaaaaggcgactatggtgttgcgaactcaagatggtgtgccagtctatgatggcgaacaaattcagatcggtggaaatgaaacctatatctcagtttgccgtaaacattattttgcccctgaaatcaataaggagaatgaagaaaaatgaacatctatgatcaactacaagctgtagaagaccgttatgaagaattaggagagttgctcagtgacccagatgtggtttcggacaccaagcgtttcatggagctttcaaaagaagaggcttctactcgtgatacggtaactgcctaccgtgagtacaaacaagtccttcaaaacatcgttgatgcagaagagatgattaaagaatctggcggggatgcggacttggaagaaatggccaagcaagagctcaaagatgccaaggctgaaaaagaagaatacgaagaaaaactcaaaattttgctccttccaaaggatccaaacgatgacaagaacatcattcttgaaatccgtggcgccgctggtggagacgaagcagcacttttcgctggagatttgctaaccatgtaccaaaagtatgctgaagctcaaggctggcgctttgaagtcatggaggcttctatgaatggtgtcggtggtttcaaagaagtggttgccatggtttcggggcaatctgtttactctaaactcaagtacgaatctggtgctcatcgtgtgcaacgtgttcctgtgacagaaagccaaggccgtgttcatacttcgacagcaacagttcttgtcatgcctgaagtcgaagaagtagaatacgatattgatccaaaagaccttcgtgtcgacatctatcacgcctctggtgctgggggacagaacgtcaataaggttgcgacagcagttcgtatcgttcacttgccaaccaatatcaaggttgagatgcaggaagaacgtacccagcagaagaaccgtgagaaggccatgaaaatcatccgtgcgcgtgttgctgaccactttgcacaaattgctcaggatgaacaagacgctgagcgtaagtctactatcggtactggtgaccgttcagaacggattcgtacttacaatttcccacaaaatcgtgtcacagatcaccgtatcggcttgaccctccaaaaactagataccattttgtctggtaaattggatgaagttgtggatgccttggttctttatgaccaaacgcaaaaattagaagaattaaacaaataatgaaattagctcaattattttcagattttgaagaagaattgataagacaaggagaggaagcagaaagcctctcttttgtctatcgtagcctgaaaaatctatcttttacggactttgtttttgccctccagcaggaagtgactgaagaggaagaagtatttgtaaaagaaattttccaacagttagcaactcataaaccggcacagtacatcattggacaggcagatttttatggaatgcagttaaaagttgatgagcgagtattgatccctcgtccagaaacagaggagttggtggagcttatcctggctgaaaatcctgagacgaatttttcagttctggatatcggaacaggtagtggagccattgcccttgcattagcaaaaaacagatcagcttggtcggtgacggcagcagatatttcccaagaggctcttaaccttgcgtccgagaatgctaaaaatcaaaaacttaatatatttttcaaaaaatctgattgttttgcagaaatttctgaaaaatatgatataattgtatccaatccaccctatatctctcgtgaagatgagtcagaggttggcttgaatgtcttgcattcggaacctcatctagctctttttgcagacgaggatggcctagctatttaccgtagaattgcggaagatgcaacagactatctcaaagatggtggtaagatttaccttgaaattggatacaagcaaggtcaaagtgttcctgaactttttaggaaacatcttcctgaaaaacgattacgaacacttaaggaccagtttggtcaagataggatggttgtaattgatgatggacaggattagacaagagttggaaaatggtggagcggtcgttctacctactgagacagtttacggtctctttgccaaggctctagacgaaaaagcagttgaccatgtttaccaactcaaacgtcgtccaagagataaggcgcttaacctcaatatcgcctctctagaggacatcttgcacttttctaagaatcagccaacttatctacaaaaacttgtagagacctttttaccaggtcccttaaccattattctcgaagctaatgaccgagttccctattgggtcaattctggtcttgcaactgttggatttcggatgcctagtcatcccattacccttgatttgattcgagagacaggacctctgattggaccgtcagctaatatctcaggtcaggcaagtggagtgactttttaatcaaattctagaggattttgaccaagaggttttgggtttggaagacgatccttttctaactggacaggattcaactattttggatttgtctggagacaaggtgaaaatcttacgccaaggggccattaagcgagaagatattcttgctcggttgccagagatttcttttgaggaggaatgagatgttaagagacttaagagaaactgatgtgaaagcaatatgtgagatcaaccaagatgctttgggctattcttttagtccagaggaaacggctagtcaattagctagactatctcaggattcccatcatttcttacttgcttatgaggatgaatctactcatgccttgcttggatatgtccacgctgaggtctatgaatcactttattctaaagcaggatttaatattttagctttagcagtttcacctcaagcacaagggcaaggtattggtaaaagcttattacaagggttggatcaagaagcaaaaagacgtggttatgggtttatccgcttaaactctgccgatcatcgtctgggtgctcatgcattttatgaaaaagttggttatacttgtgataaagtgcagaaacgatttattcgcatcttttagtttattttcttgttgcaaaacaaactaaaggaccagtcacactataaaggagaagacctatgatttttgacaaagacgattttaaagcatatgatgctgatctctggaatgctattgccaaagaagaggaacgccaacaaaacaacattgagttgattgcttcggaaaacgtagtttccaaggcagttatggcagctcaagggtctatcttgacgaataaatacgctgaaggttacccaggacgccgttattatggtggaacagatgtagtagacgtggtggaatctctagccattgaacgcgcaaaagaaattttcggtgcaaaatttgccaatgtccaaccacactcaggaagccaagctaactgtgcagcttacatggccttgattgagcctggcgatacggttatgggaatggatttggctgcaggtggtcacttgactcatggggctcctgttagcttctcaggtcaaacctacaactttgtttcttatagtgttgatcctgaaacggaactcttggattttgatgctatcttgaaacaagcccaagaagtaaaaccaaaattgatcgtagcaggtgcttcagcctattctcaaattatcgacttctcaaaattccgtgaaatcgcagatgctgttggggctaagcttatggtggatatggcccatatcgctggtttggttgcagctggttttcacccaagcccagtgccatacgctcatatcactacaacaacgacccacaaaactcttcgtggcccacgtggtggtttgattttgaccaatgatgaagacttagctaagaaaattaattcagctattttcccaggtattcagggtggtcctttggagcatgttgtggcagctaaggctgtttctttcaaagaagttttggatccagccttcaaggaatatgctgccaatgttatcaagaacagcaagactatggcagatgtcttcttgcaagaccctgattttcgtatcatttctggaggaactgaaaaccacctcttcctagtggatgtgactaaagttgtagaaaacggcaaagttgctcaaaacttgctggatgaagtcaatattaccctaaataaaaactcaatcccttasgaaagcttgtcaccattcaagacaagtggtattcgtatcggagcagcagccattactgctcggagctccctcaccaagaaagtcgcaaagtgaaagaacttattttataaacctttaagaatgcagaaaatgaagctgtctaaaaagaaaaaagaagtgcggttaaagaattaacagatgccttcccattatacgaggactaaaacttttatggacatttatattaagaaagctattctttcatcagttcagtccggatgacaccgacctgttcctagcggataagtttctcaatattactccaaaaatcgaagaatacttgcgtaaaaaaattgaacgtgtgtattcagatgaagccaagtctgggattttcgaggaagaaaatcccttcttcaatcatattacagacgatttgttggagacatcagtaacgctggctaatctctggaaagaggagttcagcatttccgaaaatctcaagaccaatgacttgatttttgtgcaattttctaaagaaggtgtagaacatttcgctttcttgagaattgccctgagggagaccttgacccaccttggtggagaagttgataatccaatcaagctaactcagaataacttgcctggatttggaacgagtgccgacgaagccttggtggttaatcttcagagtcgcaagtaccacctgatcgagaaacgaattaagtacaatggaacttttttgaactacttttcagacaatcttcttgctgtcgctcctaagatttctcctaagaaatctatcaaagaactggaaaagacagcccagagaattgccgaatcttttaatacagatgattttcaatttcaatctaaagtaaaatcagcgattttcaacaacttagaagaaagcaatgaactgtcgccagagaaattggccaacgacctttttgacaataatctgacggctcgtttgagctttattgatcaagtcaaggaagccgtaccagagcctgttcaatttgatgaaattgatgccagtcgtcagcttaaaaaatttgaaaaccaaaaactttccttgtcaaatggaattgagcttatcgttcccaataacgtctatcaagacgccgagtctgttgagtttatccaaaacgacaatggaacctactctatcttaatcaaaaatatcgaggatatccaaagtaaataatgtttwaacgaattcgaagagtgcttgtactagcagtcttcctttttgctggatataaagcttaccgcgttcaccaagatgtcaagcaagtcatgacctatcaacccatggtgcgagaaatcttgagtgaaagagacaccccagcaaacgaagagcttgtgctcgctatgatttataccgaaacaaaaggaaaagaaggcgatgttatgcagtctagtgagtctgctagtggcgctaccaataccatcaatgataatgcctctagcattcggcaaggcgttcaaactctgacagacaatctctatctggcccagaagaagggggtagatgtctggacggctgttcaagcctacaattttggacctgcctatatagattttatcgcccaaaatggcaaggaaaacaccttagctctggccaaacagtactctcgtgatactgttgctcccttgcttggtaataccactggaaagacttatagttatattcaccccatttccgtttttcacggtgccgaactctatgtaaatggaggaaactattattattctagacaggtgcaacttaacctttacattatcaaatgtttcactctcttttcgacatctggttagtccagatgtttttgttataagttttctttaagatagatatattactctagaaaggtaaaggaggaaattccctatgagaaagaaactctttctgtccagtgttgcggtcttgtgggcagtaacagctatgaatagtgtccatgcagcaacagatgttcaaaaagttatcgatgaaacctacgtccaacctgaatatgtcctaggttcatcattgtctgaagaccaaaaaaatcaaacccttaaaaaactaggctacaatgcctcaacagacaccaaagaactcaagaccatgacacctgatgtctattctaagattatgaatgtggccaatgaccctagcttacaattgtattcatcagccaagattcaaaagctaggggacaaatcgccacttgaggtcaagattgaaacacctgaaaacatcactaaggtaactcaggatatgtaccgaaatgcagccgtaactttgggtgtggaacacgccaaaatcactgtagcagcccccattccagttacaggagaaagtgctttagcagggatttattattcgctagaggctaatggagccaaggtaccgcaagccaataaagatttggctcaagaagagttgaaggctttgtcagatatcaatgctgaaaacaaggacaaaactggctatgatgctaataaattaaacgttgccctagccgatatcaagtcaggactcgccaaagctaaagaaagcaagggaaatctgacagaggaagatgttcgtaaaattgttgaagataccttgaaaaattacaaacttgatcaggttataacaggaaaccagatcaatatcatcatcaattttgctttgaatctctcaaagagtgatatcctcagcaatacagacttcactaaaaccttgaatgacctgaaacaaagtattgtttcacaagctggcgacagttttaaaaatatcaaccttaactttgatgctgataaggcgctagaggacggtggtaacttcttaagctccctctggcaagccattgtcaacttcttcaagagttttggttcttaagaaatttcatggtataatagatggtaaccgtaacgttgccgtcttttttgtcggccaatagaaagatgaagagaatgttaaagaaaaatgatattgtagaagttgaaattgttgacttgacccatgaaggggcaggagttgccaaggtagatggcttggtattttttgttgagaatgcattaccgagtgaaaaaattctcatgcgagttctcaaggttaataaaaagattggttttgggaaagtggaagaataccttgtccagtcaccacatcgtaatcaagatctagatttggcttacttgcgttcaggaatcgcggatttaggtcatcttgcctatccagaacaactcaaatttaaaaccaagcaagtcaaagacagtctctacaagattgctggaattgatgatatagaggttgctgaaactttgggtatgaaaaatccagtcaagtaccgcaataaggcgcaggtgcctgttcgtcgagtgaatggtgtcttggaaacaggatttttccgtaagaattcccacgatctcatgcctttggaagatttctttatccaggatcctgtgattgatgaggtagtagtagccctacgagacttgctccgtcgttatgatttgaaaccttatgatgaaaaggaacaagctggcttgattcgaaaccttgtggtgcgtcgtgggcactattcaggacaaatcatggttattttggttacaactcgtcccaaagtttttcgtgttgaccaattaattgaacaattaatcaagcagttcccagacatcacgtctgttatgcaaaatgtcaacgaccaaaacaccaatgcgatttttggcaaggaatggcgtacgctttatggtcaagactatattaccgaccaaatgttgggaactaactaccaaatcgctggaccagcattttaccaagtcaatactgaaatggcagagaagctctaccaaacagctattgactttgctgaattaaaagaagatgatgtggttatcgatgcttattctggtattggaacaattggcctctctgttgcgaaacatgtcaaggaggtctatggtgttgaagtaattccagaagcggttgagaatagcaagaagaatgcccaattaaacaatatttcaaacgcccactatgtctgtgatacagccgaaaatgccatgaaaaattggcttaaagatggaattcaaccaagccttatcctagtggacccaccaagaaaaggactcacagaaagctttatcaaggcaagtagccaaacaggagctgaccgcatcgcctatatctcttgtaatgtcgcaaccatggcgcgtgatatcaaactctaccgagaattgggatacgagttgaataaagtacagccggttgatctttttcctcaaacgcatcatgtggaggcggtatcactgcttgtacgagttgaagcatcagcgaggtaaaagtagatgttcagccaatgcgacgaggtaggaccaaaggtcgataaggtgtgttctgggtataggactctttaaagtaagtaggaaatatgatgagatgatacagagagcctgaattggtcaggtgacgtgcttatttacattagactgataatgaaaatggagagattatcgatggttatattggaattgtaccaaaatgattattctaaagatttagttgcgtttgattccatagaagatgggaaagcctttgtagctcaaatcccgggatacactctggaaacagaagatggttttgaagtggagtattttaatcctaaaaacataccggattatatggaaattatttttaacgggaatattgttcctttatctaaatttatgttcggtcctgaggaaaatgtagacattatttggaaagagatttcaaatttatccctcaaaaacgatagagtgatcgaaggatattcaaaaatcgatgcatatgttgttaacaacgatgaagttaaagcctatgtcgaagcgagagaagtgaactatcgccaggcaaaagactttctagaaggcagtggatatgaagtagacagaagctttttcggaagtgaagacggcgaagcgattctctacagaaaaaaaggtgccgaagattggcatttcttgtgtcacttagacccaatgtttgtagagattgaagatgtagaaggatatgttaaagaagagatgggagagattcaatagtcaaccaaagttccttgtgagtatgtacctttgctagtaaaagcgtcaaaacgttgtaacgaaagagattatgaaaatctttgaagttaagactttttcttgtgtgtctgaaaagtctgtgacttgtattccttagtcaccttatttacaattacctaaattctatagttaataaaaattgagaggtttgtatgtggactcaacgtaaacagtatttaacccaatttatcgaaatttcggactatttgaaaaaacacggtttctttcacgattttttaattggatcattctcttatgatagtcaggaaaaatccattttgttaaccattgaggaagattttactacaactaataataccaattcgccttcccttatttgggatttaaagtgtaagggagtgcatgatttcttaatggaagatatggatggcctttccaagtggtggatctctgaaatactgatggacgacgatgatattcagtttcaactcgtcaatggatatttttcatttaaaatggaatctgtatctttaggtattcctcaggaaataaatcaaaattctgtccctaaagtttcttctttacatattgactaccttattcaagagtttagagcgggtatgaatgttgatgaaacttcattttcttttgagaaggataatcaggattttatatgctatattggttattcagaaaatgagctcttgccatattgggcgggtctatgtgacttacctgatggtagaagatttcgaacagctgatgaactttttgaagcaaggatttatgatggtaaatcgctaaaagagaggtgggatgaagttactatttatagtatcaattctttgccacttgatgattggttgagttgttagccacattccgttgagacaactgtttatgaaccagaggatgattacgctctgtatgttaatggtgttaaacttgagggttttattgatgaagattctatatgtaagacatgtggtgctaatcaatgttatttggacgattatgatgaatatttttgcccctattgtaatttatggatgtataaagatttttgggatagtgatgaaacacactattttaaaaaaagacccctagaaccagagttgttatggaaaccaagtaaagaattgaatttttgtaatgttcgattctttccgaatgacaaagaatatgtgtattattgtcctgatgagtcaatagagaaatttgattggatagaagttcctgttgggaacaaatctcatttaaaagaagcacaagttactgaagttttcaagagacaagccaataaaccgccatttcytcttgaaaaaataaaaaaagtagaacgaaaactatctactataaacaaaaaaattttagaaactcaaaatagtctattaagtgaaggagttatctgcgatttatcagaagctaaaaatatagtaaactcaaagcaagcttatgatatcctaaaaacgccaatcggaaacttttggttagagcttaatggttcccccataaaaatttccattggcgcacattatccaaataatgatgaagaatactatgtggaagcttcttattacataaaacctctcaatccagattttgaaaagtttaaatcgttgacaatctgctcagatattgatttaagaagttcaagattaatagataatttaggtggtgagcataaagagggttataattggcaagtctataatattgatttaggtattgtggctcatccatattcttatctagaacaggaagtctctgaaactcccgttggacttccatattatgtagaatggattgaaaaatataaagaactctatggatttacagttgcttggaagtattttgtatctgatgacgatttgtcagtttggtttaatacataaaattttcatataattttaatagataaattaggagtaatttagcattatatctaaaagtaaaatttattccactaaaagttgattgacgacttttaaacaatttatcctagcatagttaggaatggagagataagatgatatggactaaggaatatttttctaaaattgaatttattattcattgtggttgtgaaatttttggttattttgagtgtaatctgatgaactctgaactatcctaccaagagtgtgggaatactggaatgatcgtttttgaacatagtcagaaactatccgaaaaagccttatctaaacttatgaaatatacgctacttattgattttgagaaatatagaaaggggaataattcaaataagaatgataaagttattggttatagagatgccttttcgataactttcaagggctatagtcaagatggacaagctttattgatatataatatggactatgtttacaaggattggtacaatagacccgttgatagcttatatagttttataagcgatacctatttttcagattttcaaaataatagatgttttattgctcaagggctgatggctggtgtacttccgttttaggtataataggaagatgtagtacataatggaatcaaaaaagttatttaattataatttgattagatgaatacctataaattataaaaaattcgttaatagataatttaaaaactatagttgatggtcaaattcccgatatcttacaaggaggaaacggatgctaggagcaatagttggagatattgtaggttcagtttactaatggaacaatatcaaaacgaagatttttctttatttcgtgaggattgtttttttacggatgatatggtaagtccgaatcgctgagtgtgtgattgtgatctggtgtcctaagtatgaaaaatggcaaacagtaaagtactcttttaaggtgaaaacctaaactggttttaaggaggtgttatattgatagagagcagacctgagtttgataaaatcgtatcatttgatgagtttaataaatattattggtatcgtgatgaactttcacaactatgtaagtcattaggattagaatatagaggtactaaacaagaactcaatcatattattgagcagtactttcaggggaattttattaaaaaatcatcaataaaaaataaaaagaaacgagtagaagtcgttaccttggacacacccttgcttgaatgtggattctcctttaatgcacactttagagaatatttctcaactttaacagatgtttcgccatttaaatttactgctgatatggctacagcttggagaaaagtaaaaagagaaaatgatttgagttttacaatccaagatatgctaaaagtctattatggaaattcagattatgccaagtatgatcattcggtttgtcaatggaatcaatttttaaaggatttctgtgtagacgaaaatagtcgtaactactcaaacaagttaaaagtagcttctattctttggaaagaagttagaaattcaaaagctgaaaaaatttattcaaagaatcttttgactgaatatgctgataaaataaaagagtatgggaagtagaaaaatcagtctaaaccaatagttcacgaggaggaatcttatgctaggagcaattatcggagatattatcggttctgtttacgaatggaacaatatcaaaacgaaggactttcctttatttcggaaggattgcttttttacagatgacacggttatgacctgtgctgttgcagaggcgattatgaatgggggacaaaaagacgacttcattgatgctatgaagaaatatggtagaatgtatcctgatgctgattatggtgctcggtttaatgcatggctaaacagcgataaccgtgagccttataatagctttgggaatggttcggctatgcgtgtttctccatgtgcttggacaatggactgtggtttttgtgcgagaaccggaatgtggccatcatctagggaatttgcgagtctttctgcagaggtaactcataatcatccagaaggtatcaaaggtgcaatggctacagctgatgctatctttctgtgtcgttattactttggaggttattgcggagattatgagcaaccaatcaatgacaatcctacaaagtgtaaaagacggattaaggattatattgagcaggaatacggctacaatctatctcaaactttagatgaaatccgccctacataccgtttcaatgaaacgtgccaggataccgtaccacaggccattattgcatttctagaaagtagagacttcgaagatgcgataagaaatgccatctcacttggtggcgacagtgatactctcgctgcaattactggtagcatagccgaggcggcatacggtattcctgactggataaaggataaggccttttcttacttggatgaatccttaaaggatgtagttatacgatgggaaaatagaataaaagcgtattaatctccagtacgtcagatttctcttttctgtattttcgtagtataatagggatacgtttagtttcatataatgagatatatatttttaacgaatattaaggagaacattaatgaaaaaagcaatggtaattatcaaccctacttctggtggcgaaaaggctttggattacaaagaaaagctggagaataaagcaaaagaatactttgagcacgtggaaaccaaaattaccgaaaaggcgctggatgcaacacattttgctgaagaagcttctcgtgagcagtacgatgcagtggttgtgtttggtggagatgggactgtcaacgaagtcatttcgggtattgctgagagagactacattcctaagttgggtattatcccaggcggtacgggtaacctcattacgaaactgttggaaatcaatcaagacatcgatggcgcgatagatgaactggattttgatttaaccaataagattgatatcggaaaagcgaatgacaattattttggttatatctttagtatcggttctctacctgaggcgattcacaatgttgaaatcgaggacaaaacaaaattcggtattttagcctatgctgtaaataccatgaagtctgtcatgacagatcaggtctttaacattaaggttgagacagaaaatggaaattatgttggtgaagctagccatgtgttggttctcttgacaaattacttcgctgataaaaaaatctttgaagaaaacaaagatggctatgctaatattttgattctgaaggatgcttctatattctccaaattatccgttattcctgatttactaaaaggggatgttgtcgcaaatgataatatcgagtatatcaaagctcgtaatattaaaatttcttctgatagtgaattggagtcagatgttgacggtgataagtcagataacctacctgtagaaatcaaagtcctagctcagcgagtagaagtattttcaaaaccgaaagagtagaaggtaaaaattagtttattattcacaacgaaattaagtcctatatcaacgattggaggaggaatgaattctctatttgatgaatttcgaataatttgttctcatttaaaccaaatcggaatcactccgacgctcatggggtctttggggtttgaataccgttcaaatgaagaatggaggccgtctgacattgacattcatgtgcctggtgatcctagaggttgggaagcgcctgatcatctcagaatttatgagtgggacaagataatgaaagtgatgaaacacttaggctatgacttaatagatattcatgagcatgaattcaaaaaagatggactgagtgttgaattcggaagtatcgattctttacctgattttgcaggagtttcggaatcggatatagagctgattcatctcgaaaacatcacttttcgcgttccaagtttggaacagtttttaagtatttacaaggcttcttcccaagattcctatcgaaatgatcacaataacaataaggattttaaaaaaatagagtggttgcaaagatattttttaatcatcatttgaaaagtagcaagttgtaagactggctgcttttttatttatagaaccaaaccactagaatctacggataagccttgaaaataaaatacgaaagtagtatactagaatcacaattatgaaaacgtttgcgtaaaattggaattaaaactttaggagacaaattgatggaattaagtgctatttaccataggactgagtcggagtatgcctatctttataaggataagaagattcatattcggattcgaactaagaaaggggatattgaaagcatcaacttgcattatggggatacttttatctttatggaggagttttatcaggatacaaaagaaatgtccaagataacttctgatggcttatttgattattggcaggttgaagtgtccgttgactttgcacgtatccagtatctctttgaagtcacggatacagaaggtcaaagtattttgtatggtgataaagggtgtgtggacaattctctagaaaatcttcatgctattggaaatggatttaagttgccctatcttcatgagattgatgcctgcaaggttcctgattgggtttcaaatacggtatggtatcagatatttcctgagagatttgccaatggaaatgctcgattaaacccagaaggaacattagactgggattcatcaagcacacctaaaagtgatgatttctttggtggtgatttacaggggattattgaccatctggattatttgcaagacttggggattactggactttatctttgtcctatatttgaatccacgagcaatcataagtacaatacgacggattattttgaaattgaccgtcattttggagacaaggagaccttccgggagctggtcgagcaagctcatcagcgtggcatgaaaatcatgctggatgcggtatttaaccatattggttcgcaatctcctcaatggcaagatgttgtcgaaaatggtgagcaatctgcttataaggattggttccatattcaacaattcccagtgacaactgaaaagctagttaataagagagacttaccttatcatgcttttggtttcgaggactatatgcctaaactaaatacagccaatccagaggtcaaggactatcttttaaaggttgcgacttattggattgaagagtttgatatcgatgcttggcgtttggatgtggctaatgagattgaccatcagttctggaaggattttcgtaatgcagttttagctaaaaagcctgatctttatatcctaggagaagtctggcatacgtctcagccttggttaaatggagatgagttccatgcggtcatgaattatcctttatctgatagtatcaaggactatttcttacgaggaattaagaagattgatcagttcatcgatgaaatcaatggtcagtctatgtattacaaacagcagatttcagaggttatgtttaatctcttggattcgcatgatacagaacgaatcttgtggacggcaaatgaagatgctcaactggttaaatcagccctagcctttctctttttacaaaagggaacaccctgcatttattacggaaccgagttagctttaaccggaggaccagacccagattgtcgacgttgtatgccttgggaacgtgtatcaagtgacaatgatatgctgaatttcatgaagaaattgatccagattcgcaaacatgcgtcagcaaccattcagcatggcaagtatagcctaaaagaaattaaagctgatgtagtagccttggaatggaaatacgaaggccggttccttaaagcaatctttaaccaatcaaaagaagactatattatagagaaagaagcagtatcactagcaagcaattgccaagaattagagaatcagcttgtgatttatccaaatgggtttgtgatttttcattaaagaacaattatgagcgacaggaaagttgtagtatagagaagactttacaaacagactatttgtcctcttgctacaaatgatatataatttaacatagagaaaataggaggactaatcgaatggaattaaaagattttacagaaaaagaacaggaaatgattaagaagggacttacgacgtctaagattagtgacaaggaaactgctgagaagattcttgcgctagtaccacaagacttgattaagcgaattccatttttcgtcagaaaacatgctacgactcgtacgattaaacgcatttcaattgaacaccctgaactctacgctgcagctcaaacaagtggtgagattccggaaaaagaacgcgaagaattgcgtcagattatcacgactatctttgagcaaaagatgaataagcatagtattaagtagagaatgaaaaaatattttattggcggtctgggaagcaatatctatcatagcaaggattttcttcaagaactagattcgcaggtttattttctaagtccatatgaaaagcatcttcgagatgaaacagaattgaaattatggtttaaaaatgagattgtagaggaagaatctatctgtctgataggtcattctcttggaggagatttggcgcgttatctcgcatcggaatttcatgaagtgaaaaaactgattcttttggatggtggctatctagatttagataagattttaactttagatgcggaattagaggaaactaaaaactatatcaaatctcaagtcgtttcagacttagctcttcttatttctaaagaaaaatctgaagcaaagcattggtcagaaaatatggagaaagccgtaagacagtcatatcactggaattctaagtataatagatatgagttagctataaaatatgaaaatatagaagcgatactccgcctacggaggaaaatacaagcttttaagagagaagtgggagataccttgtttatcagtcctcgctatcctaatgaagctacatggagagaggaagccctaaaagaattgccagactattttgatactattcttttagagaactttggccatgagctttatactgaagcccctagagaaatcgctagtctaattaatgagtggctcgcttattctcaatgagctacttgcattacttaaaatgttataagatttaaatctaaaaatcattattactcatataacaaaaaacgaacaggctctttttctgtcattcagaagagaacttgttcgtttttatcttgcttttttaaaacacgcgatacacatagggattctctggtttatcgactttggtaaaactatcgatttccaaggttgggaggttttgtttgagttctttatgatagtgattgaccagttttcctttggctgttatccaggtattattctcatactgacgggtatttcccttggtcagcaatccatagacaccagaatctgcgatacaatggataatgccgaagcggaatagaaattggctattggcatgactggggtcgttatagacaaagcctgtgaactggactgtcttgccctcaaattcatctggatagtcgtagatggcttccatgacttccatatagttttcgttggtaatctgaatgctatcttgggataagtatttattcgccgaagttcgcatttccttttcataagctgcttttgaaaaataagaactggtatctggtttcaaatattggcttgtcgttccttcactggtctgaatggcttgatccgtgccttctgataaaggaaaatggtagcctttggcagaaacggtctgagaatccaagctaacagttggaaaagttaaaccgacgacaataggaatggcaagaagagcaatactagttcctttagataatcggctattcagatgactgtgggttttgacttgcttcatccagatatacagctggacgattgccaagataaaggaaagcaccatggaaatataggccagataggaatagtgcatgttgatgtactggtttaatttgccggacagatggagataaatagtcaattcaaaatagccagctaaaactaaaaatcgaatcataggacgactccaatcaagagagaatatactaagacaacgagtgtcacaatcgtaatgaactgactgataaatcgtgctttcaagtaatttttcatcatgagaatatttttgatatccagcattgggccaattacgagaaaggccaaaactggtgctaagccgaaactcgagagaagagaagatccgataaaagcatcagcctcactacagagagaaagaagaaaggctaaaatcatcaagagcaggatggcaaaaagaggggttgcactgatagaggtcagaatccgtgtcggaacatagacctgtataacagaggcaaagagacagccaaataccaaataacgccccgtatcaaaaaattcatcaatggcctgcacaaagacctgaaaaactttttttgcagagctcaagtgagaaaaatcatgctcatgacaagccaaccgatcttctttttgaatcggttcttgccagaaaaatcctagaaaaatcccaagtatcacagccacaacgatggaacccagagctcgcaatagggcgatatggaaggagttgccaaaggcagaataggtcgcaaagagaacaatgggattgataacaggtgctgtcacaagaaagggaacggctgtgtaactgggaacctttttttccagaaaacgattgataatggggacgattccacattcacaagaagggaaaagcatcccgacaaaggtcccaaaaaagattctcccccaacgatttcgagggagaaaatgataaaccttttcaggtgtgatataaacctcaatcagccctgaaacaatacttcctatcagaacgaagggtagggcttcaatgattatagagagaaaaatagccccagtctgaagcacactagaagggagttgttggaaagcagtcatctagtttttcttttctgctttggcttttttctctttgtcatcagggaaagtgacttgtttcaaatcagggagtttagcaaactcctcaaacatcttgtccaagtcatcagtttttgtaaattttacagccataggtgcacctcgattctaaattctatctctattatactattattttaaggaaaagggaaaagttaaaattgagtatctaacgaataatagagcttgatatatcctgatatacactatgattgtgatataatagttgtggaataacggaggaaatgatggatcatgaaacaatcggtcaggttaccgatgaagtaaaagaaatttttgatattgttcttgaagcgagcgacataaaggtcaacaaagacggtttgagaagccatatgataaaacgccatcacaatgatgtgattcatcatattgaagacctggaactcatactaaggaacccagatttcgtcggggtcaatccacgagagaaagacgccagtttcgaatatgtaaaaagatttgatgataatgttcttgtttccatcaagttacataaaagtggagatttcttttatgttctgaccatgtatcgcttacaagatttcaagttacaaagtcgtattaagtctgggtagattgagaaagcttgacaaaaaaatagatagtgctagaataacattaacgaaagacatttgagggcagaaaggttcctgccgcaccttgaagaaggtatctgagatgctgggtacaccgaccagccaaatgtccgttatttcaaaggaggggcttaaatgctccttttttatttaaaatttcaaaatagattatccccaccgcagactctgtcttgcggttttttatttttcaaaaacacgcattttggacgattagaaatagaaatctaaatgctattcttcaccacaacaattaggataaataatttttaacacgagggctctcctttcaccaaatttgagtctgccgatcccttggctatcctttcctttcacaaacgagtcgcttattcaattataagtttacgtgctcctagtcacagtcagttgtgcttgatggaaagaatgacacctataaaaatgcgaggtagtgactataccactcacttattcaccaccccgtgatttgtagtagtgataggctttctcgctattattataaaacaaaataaagagcacaacactttttcattctgtgttgtgccttgagtgaaacgaaaggaattaattataaaagtttaaaaagtcaatgtgttattccaggtcaggaacatcttccagaactggctattatgtctgatccattaaatacttttgatgtcatggagtggtaaaaaaaggtggcaatgctctctaagtacaagttattgcactatagaatataaatctattccccacatattgtttttaaatactgtaagagctaatttgaaacgtttagcttatggtataatagattcatggataaaaaatatgaaaaaatctcccaggatttgggagtgacgttaaagcaaattgatactgttctaagtttgacagctgaaggggcgactattccctttattgcgcgttatcgcaaggatatgactggtagtttggatgaggtgacaattaaggccattatcgacttggataaaagcctgacaaatctcaacgaccgtaaggaagctgtcttagctaagattcaagaacaaggcaagttgaccaaggaattggaagaagctatcttagctgccgaaaaattagcagacgttgaagaactctatcttccttacaaggaaaagcgtcggaccaaggcaactattgcccgtgaagctgggctctttcctcttgctcgcttgattttgcaaaatgtagctgacttagagaaagaggctgaaaagtttgtctgtgaaggatttgcgactgggaaggaagccctgtctggtgcagttgatatcttggtcgaagccttatcggaagatgtgaccttgcgttccatgacttatcaggaggtgctgagacactccaaactcacttctcaagttaaggatgaaagtctggatgaaaagcaagtttttcagatttactatgatttttctgagacagttgggaatatgcaaggctatcgtaccttggcgctcaatcgtggggagaaactagggattttgaaggtcggttttgaacatgcgacggaccgtattctagctttctttgcagctcgtttcaaggtgaagaatgcctatattgatgaagttgttcaacagtcagttaagaaaaaggtcttgcctgctatcgaacgacgcattcggacagaattaaccgaaaaagcagaagaaggggctatccaactcttttctgacaatctgcgaaatctcctcttggttgctccgctgaaagggcgtgtggttctaggatttgaccctgcctttcgtacaggtgccaagctagctgtcgtggatgcaacaggaaaaatgctgacaactcaggtcatttatcctgtcaaaccagcctctgctcgtcaaatcgaagaagccaagaaagatttggcagacttgattggtcaatacggcgtggaaattattgctatcggaaatgggacggccagtcgtgaaagcgaagcctttgtggcagaagttcttaaagattttcctgaggtcagctatgttatcgtcaatgaaagtggtgcttctgtctattctgccagtgaactagctcgtcaggagtttccagacttgaccgttgaaaaacgctctgctatttctattgcccgtcgcttgcaagatccccttgctgaattggtcaaaatcgatcctaagtcaatcggtgtcggtcaatatcagcatgatgtcagtcaaaagaaattgtctgaaagtctggactttgtcgtcgataccgtggtgaaccaagtcggtgtcaatgtcaatacagccagcccagctcttctttcccatgtcgctggactcaacaaaactatttctgaaaatattgtcaaataccgtgaggaagaaggaaaaatcacttcacgcgctcaaatcaagaaggttcctcgtctgggagccaaggcttttgagcaggctgctggtttcctccgtatcccagaaagtagcaatatccttgataatacaggagttcacccagaaaattacgctgctgtcaaggaacttttcaaacgcttggatatcaaagacttgaacgaagaagcccaaagcaaactcaagtccctatcagtcaaagatatggcgcaagagctagaccttggtcctgaaacccttaaagatatcattgccgaccttctcaaaccaggtcgagatttccgtgattcctttgatgcacctgtgcttcgccaagatgtcctagatatcaaggatttagtggttggtcagaagctagaaggtgttgtgcgtaacgtcgttgacttcggtgccttcgttgacatagggattcacgaggacggcttgattcatatttcccatatgagtcgcaaatttatcaaacacccaagccaagtggtgtccgttggtgatttggtgaccgtttgggtcaagaaaatcgatactgaacgtgaaaaagtcaatctgtcgctcctcgctccaaatgaaactgactgattacgttaagcaggtttcactagaagacttcggcagaccttttatccatcatgtccagtggaattctcgtctacgttcgacaggtgggcgatttttccccaaagatgggcatttggattttaatcccaaggtttatcaggaattggggttggatgtttttaggaaaattgtccgacatgaactctgtcattatcacctctattttcaagggaagggctatcaacacaaggataaggattttaaggaactgttgaaagcagtggatggattacgctttgtaccaaccttgccaaatagccactctaaaccactcaagctctatcgttgtcaatcctgccagcaagcttatcatcgcaagcgaaggattaataccaaacgctatcgctgtggactttgtcgaggtaaattgcttctgataaatcagcctgaggactgatgaaagccgagcctacctgtgatatactatgtttaacatagcagaaagaggaaatatcatgaacagtaaattttataaaatgagacgaaatcgcatgatttcaggagttttggcaggtctgtcagacaagtggaattttgatgttacccttgttcgttttctatttgctatttttacagtcgcaaactttggacttggcgtgattatctatatcatcctagcttctatcatgcctaccaaggaagaaatcgaagcagaaatgtacggaacaggcccacgtaaacgcaaagaagctcaagccattgacgataatgaaggctggttttggtgaggtttaacaggaaatatttattatttgcactatttaaaagaagtgacataaatgactgaaaatcccttgttgctatttagcgacaagggattttggtatttaattataatctgtttcgtctttagaaagacgaattacctgatcagccattttccaaatactaggattgtgagttgcgatgataattgttctatttgcattacgaagttcaaggagaatttccataatttccttagaatttttaggatctagtgaggcggttggttcatcagctagaattaaaggaggattttttaggataatcttggcaagtgctacgcgttgagcttcaccaccagataattcatagattttttggttgagacttagataatccagtcttacagcttgcagtgcttgaagaagaagtctctctttttcttgtttcttgttcttttttttaccaatcattcccagctcaaggttttctcgaatggtctgactttctaatagtccaaagttctggaagagatagccaagttcgttacgataaaattcctcattttttactgaagtcaaaggatttcctttgtaaaatatttcccctttatcgaaagtctctagttttgctagcatattcagcaaagtggttttgccacaaccactatctcctatcaaagcatacaccataccactttgaaaattaagactcaagtctgaaaaaatgacacgagaaccaaattgtttccaaatatgttgtaattcaatcatactatcctcctttgatgatgctagcataagttttactttcctttttatcacagattttcaatagagaaacagctaatcctgaaaaactgagaaataaaatcagggtaatccagatattcttagaaataatgaaagctagactacttccgacaaagagagctattatttgagaagtgatatatctacagtgtaattcaaagaaataatacccagctatttttttcaagaatatggttttgcgaaaggcttcaaaatagagtaggtttaaacttgtaaaaagtaaaattgaagtcaagatagcaaaaataccactcgctaaattactataaatttcgattttaattttttgatttaactggaggtaggtctctctagcaaaggataatcctgaaatcataggatcaagttgatagtacttcaaaagttcttgtgtttgctgtaaatcggtaaaatagagatattctagattcgtaaaccaaaatatagaagaatcttttccaagtgccttaggagaaactacgataaaaataggggttgacaaccattgatcataagaaatatgggtagtattataaatgaatacatcttttttttgatcagtataagttatactaacttcgactctatgctttgtatcactactgtataatcgattagttaaatcttcttgtatgtttggttttatttgttcctcatttttcttttgttcttgaggtagtattacaagaacctgtccatcttttagattattgatttttttaaaggtttctgatgttaactctataccttcttttttgaagtagtcaggtgttacatagagaatatttttcccttccaagtcatagggattttgttcagaatcattatgagttgaaagagaatgctttatagcttgaatagcgagattatgtttgactaaaaaggcatttccattttctaaagaatattgaataaagtcaaaccatttattagcattcattttgagttcatctatattttttctttgacttgaacgacctgtttgaagattaacaatattggagtgttgtttccaagtagcttgtccagcctcatttttcataaatatatgatgataaatggacaagcgcccaaatcctacaataactaataagatagacagagcttgaccaaagtaaagaatacgtaaaattgacttaattggtaattttcctttaatgatagagataagatgaactcttttcaaagaaatagtaaaaagaaaagcgatgagaagacttagcaagagaagcaggctattataaaaaataaatagtattactaaaaaagtctgaatttcataaggatagcctaggtaaattactaaaacactagctattagggaagcaggcaagccgaaaagaaggatatcaagtccgtctcttatgatagaacgaaagaagagatttctgagacgttctccattaatcagtcttattcctgattgagagagagattgaatctgtccgataacaataagtgataaaaaggttaataaaaaaatgaaaagactagtaagttgattgggttgggcaatgagggtcaatacgaaggagactctattattttcaaatgtgttaactttttctagtccaagttgtttaaggtgaatagctaattcttgatttgttagcgatccactgataatattgtaattgttgagaagattacttttattgatactttcttgacttgcttgaggcatccagtctggaagtttcccatctccaaaaacttcgtagtaagtttgtgattttccatcactatctacttcccaaatggttcttgcgataagactattatgttctttagcaagactatttaatttttccttaacgatagaataatctgcttgcccgcttaatactgctgcacctgggaaaagggtttgtggaagagagtctttccaaaaggacaaagcaccaatcagaaagagtgccagaagaagattgctgatgaagagaaatatacgtttcataggaacctctttctaaaaaagagggagatcaacctccctcttcattgcagttatgcgaattatagcttactactttttaaaataagcactaaaaaactaaagttttacaaggtatcgaagaaaaccctttcacaattatattttactccttttttaaaaataaaacaagtgatgataggacttcgtatagtagatattttcaaaaaattccccaatcttacaaaaatgtaagattaaagtctcttttgtaaggttaggttatggcaagcggtctttttttgatgtaaactagactcataaagaacaaaggagtaacatcatgaaacaaatcttacataagaaaactagaaaaccaagcaataaagatatcgagcgtgttcagctgggatgcgcaatgatgcaagaaacatttcatttgatgggatattaagaaaggagattctcatgacacttttagatgtaaaacacgttcaaaaaatttataaaactcgttttcagggcaaccaagtagaagccctcaaggatattcactttaccgtagaaaagggtgactacgttgccatcatgggtgagtctggttctggtaaatccactcttctcaatattctagctatgctggataaaccaagtcgtgggcaggtttatcttaatggaacagacacagcaaccattaaaaattcacaggcttctagcttccgtcgtgaaaaattaggctttgtcttccaagactttaacttgctagatacgctttctgtcaaggataatatcttgcttccgcttgtcttgtcaagaagacccattacggagatgatgaagaaattggtggtgacagctgagaatctaggtatcaaccaattgcaagagaagtacccttacgagatttctggtggtcagaaacagcgtgtagcagtagcacgcgccatcatcacagaacctgaaattctccttgcggatgagccaacaggagcccttgactccaaatcatctgcagccttacttgatgtctttgatgaaatcaatgagcgcggccaaactattctcatggtaactcactcaacggcagcagctagcagagccaagcgcgtgctctttatcaaagacggcattctttacaatcaaatctaccgtggagagaagacagagcgtcagatgttccaagaaatctctgataccttgactgtcatggcaagcgaggtgaattagtatgtttcgattaaccaataagttagcggtatcgaacttgattaaaaaccgcaaactctactatccttttgcgctggctgttctcttggcagtcactgtcacctatctcttttactctctaaccttcaatcccaagattgctgaaatccgtggaggaacaaccattcaggctacacttggatttggtatgtttgtcgtcacccttgcgtcagccattatcgtcctctatgccaatagttttgtcatgaagaaccgttccaaggaactaggaatttatggcatgttgggcttggaaaagcgtcatcttatcagtatgacctttaaggagttagtggtatttgggattctaactgttggagcgggtatcggtattggagccttgtttgataagttaattttcgctttcttgctcaaactgatgaaattgaaggttgagctggtcgctaccttccaaatgaatgttgtcattgcagtacttgttgtctttggattgattttcctaggcctcatgttcctgaatgcccttcgaatcgcccgtatgaatgccctccagctttctcgtgaaaaagctagtggtgagaaaaaaggtcgtttcctacctctacaaactattcttggttccataagtttagggattggctactatcttgcccttactgtaaaagatcctctcacagccctaacaaccttcttcctagctgttttactggttatctttggtacttatctattgtttaatgcaggaattaccgttttcctccaaatcttaaagaaaaataagaaatactattaccaaccaaataaccttatctcagtctctaacttgattttccgtatgaagaaaaatgcagttggattagcaacaatcgctattttgtcaacaatggtcttggttaccatgtctgcagcgacaagcattttcaatgcttcagaatcctttaaaaaagtgatgaatccgcatgactttggcattactggacaaaatgttgaaaaagaagatttggacaaactcttgagccagtttgcaagtgacaaaggttatagtgtcaaagagaaagaagtgcttcgttacagtaactttggtattgcaaatcaagaaggaaccaagttaaccatttttgaaaggggacaaaatcgtgtccaacctaaaacagtcttcatggtatttgaccaaaaagactatgaaaatatgactggtcagaagctttctctatcaggcaatgaggtcggcctcttcgctaagaatgatggactgaaaggacagaaagctctaactctaaataaccatcaattttctgtaaaagaagaatttaatacagattttattgtgaaccatgtcccaaatcagtttaatatttttactactgattacaattaccttgttgtacctgatttacaagcatttttagaccaatttccagattcggctatctataatcagctttacggtggtataaatgtaaatatcagtgaagaagaacaactcaaagtcgctgaagaatatgaaaaatacttacaaaagtttaatgctcaattaaacactgaaggtagctatgtgtatggtagcaatctagcagatgctagtgctcaaatgagtgccctctttggtggtgtcttctttatcggtattttcctatccattatctttatggtcggaaccgttctggtcatctattacaaacaaatttctgaaggctatgaagaccgtgaacgctttattatcttgcagaaagtcggtttagatcaaaagcaaatcaagcaaaccatcaacaaacaggttttaactgttttcttccttcctttgctttttgccttcatacatctagcctttgcctaccatatgcttagtctgattttaaaagtgattggtgtaatagatacgaatatgatgttgattgtgaccttgtctatctgcgctatcttcctcatcgcctatgtgctgattttcatgattacttcaagaagttatcgcaagattgtccaaatgtaaaaaagatacctcgacttcaaaatcgaggtatttcttgtattctaaatgctgaaaagttgtccgagcaggaaggtaactcccatggtcaagagaccaatagcgaggttccgaatcatagctgttttggttggtgcttttccaagtctggcactagtgtaaccagtgagaagaagggccacaccgacgataaggacggtagcagggatacggtattcacttgggaaaatggtaattgaaagcatgggtggtaagctaccaaggaaaaaagaaataaagctagagatagcagcatgccatggattggtaaactcttcatactctatcccatatttttcctctaccaaagccttgagcggattatttaaaaaggctttgttggtcaagagttgagcagaggtttcacattctccattttggatataggctgcatagagagactttttggctagttccatatcttggtctagcaagacttgctcacgcgcaacggctgcttcctcggtatctttttgagttgaaacagatacatattctccaccagccatcgaaaaggcaccagctaagatagctgcaaatcctgataaaaagataatccagatattactcgtagcactagcaaccccgataaccacaccagcaatggaaataattccatcattggcaccaagaacacccgcacgcaggatatttaaacgacctgcaaaatttgaatcgatttcgtgatttgtttctgacatactattctccttttgatccagtataaaggaaaaatatagggaaatcaatcttttaaaactgtctgaaaaaagttgcactattctaatgatgtaaaaatgtcgtcatcttatctaatcgatcaaacacagaagggtaagagtatagaatggcatgaaagaattttaaattaaatactatcatcatttcgttcactttataatcgtttacaagaaaataatcattgttaaatcgagtaaaatctaactattttgcgaacctttttatattttttccgtaaaacgctttacaagttcttgaaaacatgatatagtaatggggcttagaaaatgagatgatgttttctagcaaatataaacccgagtaaaaaatgcctacggacaggcagggttgaatgccgaagcgtggttgaaaaaccacattattgatagggttaaaagcctacttttataagttgatgttaggacacttgtcctaattcataaatttttagtgtggtgaaagcacacgtcatcttgtgaaacgatcaataaagtacgtaatatttgctactagagagttaggaaacatcgggaacagacatactcaacagaaacaaacataaaaacgtcagaagattgcagagcaggtgaaaacctgctcttttttcatgagtcaacctttagttccttagttttcataaggtcctaaaaatatggaaaggagtatgtcttgaaagagttagatcaaaaccaagctccaatttatgaggccttggtgaagttacgcaagaaaaggattgttccctttgatgttccaggtcacaagcgtggacgaggaaatccagaacttgtcgaactcttaggagaaaaatgtgtaggcattgatgtcaattcgatgaaacccttggataatttaggtcaccccatttcgattattcgggatgcagaggagctagcagctgatgcttttggagctagccatgcctttctcatgattggaggaacaacttcatcggtgcagactatgattctcgcaacctgcaaggcaggagataagattattctgccacgaaatgtccacaaatctgctatcaatgcgctggttctatgtggtgccattcccatctatatcgagatgagtgtggatcctaaaattggtatcgctttaggtcttgaaaatgaccgagtagcacaggccataaaggaccatccagatgccaaggccattttgattaacaatcctacttactacggaatctgttcagacctaaaggggttgacagaaatggctcatgaagctggcatgatggttttggtagatgaggcccacggggcgcacttacattttactgataaacttccaatttctgctatggatgcaggtgctgatatggcagcagtttctatgcataagtctggtgggagtttgacccaaagttcgcttcttttaatcggggagcagatgaatcctgaatacgtacgtcagattatcaatcttacccagtcaacatccgcctcttatttgttgatggctagtctggatatttcgcgtcgcaacttggctcttcgtggtaaagagtcgtttgagaaggtcattgagctatccgagtacgctcgtcgtgaaattaatgccattggcggttactatgcttactcaaaagagttaatagatggtgtgtcggtctgtgattttgatgtaaccaagctgtcagtttacactcaggggattggcttaacaggtatcgaggtttatgacctcctacgagacgaatatgacattcagattgagtttggtgatattggcaatatcttggcctatatttcgattggtgatcgtatccaagacatcgagcgtttggtcggtgctttggctgatatcaagagactttactcgagagatggaaaagacttgatagctggagaatatattcagcccgagttagtgctgtctccacaagaagccttctattcagaaagaaaaagtttaaccttggatgattctgttggacaagtctgtggagaatttgttatgtgttaccctccaggaatccctatcttggctcctggtgaacgcattatacgtgaaattgtagactatatccaatttgccaaggaacgtggttgctccctccaagggacggaagatcctgaggtcaatcacatcaacgtcattaagagaaaggagaactagatggatttatggttttctgaagttcatactccagatgtgaaattgtccctgagaacagccaagcaactctacgctggtaaaagtgaatggcaggatatcgaagtcttggatacaccagcttttgggaaaatactgattttaaatgggcatgtcttgttttcagatgcggatgattttgtctacaatgaaatgaccgtccacgttcccatggctgtccacccaaatcccaagaaagtattggttattgggggtggtgatggcggtgtcgcccaagtattaacactctatcctgagctggaacaaatcgatattgtggaaccagatgagatgttggttgaagtctgtcgtgagtatttcccagactttgctgcagggctagatgatcctcgtgttaccatttactaccaaaatgggctacgctttttgcgaaactgcgaagatgattacgatattatcatcaacgatgcgacagatccgtttggccatacggaagggctctttaccaaggaattctacggcaatagttatagggctctgaaagaagacggtatcatgatttaccagcatgggagtcccttctttgatgaggatgagtcagcttgccgaagtatgcatcgcaaggtcaatcaagcctttccaatcagccgggtctatcaggcccatattccaaccagtccagctggctattggttatttgggtttgcatcgaaaaaataccaccctgtcaaagattttgacaaggaaggctggaaaaaacgccagcttttcacagaatactacactgcaaacttacatgtgggggccttcatgttgcctaagtatgtagaagacattttagaagaagaggaaggaaaaaaatgagtcgtttactagttattggatgtgggggcgttgcccaagttgctatttcaaagatttgccaagatagcgaaacctttacagaaattatgattgctagccgtactaagtcaaaatgtgatgacttgaaggctaaactggaaggcaaaacaagtacaaagattgagacagctgctcttgatgcagataaggttgaagaagtaattgccctgattgaaagctacaagccagaagcagttttgaacgtagcactaccatatcaagatttaaccattatggacgcttgtttggcaacaggtgttcactatatcgatacagctaactacgaagccgaggatacggaagatcctgaatggcgtgctatttatgagaaacgttgcaaggaacttggttttacagcctactttgactactcatggcaatgggcttatcaggagaaattcaaggaagcaggcttgaccgctcttcttggttcaggttttgacccaggtgtgactagtgtcttttcagcctatgccctcaaacactattttgatgaaatccactatatcgacattttagactgtaatggtggtgaccacggttatccgtttgcaacaaacttcaacccagaaatcaatctacgcgaggtttctgcgccaggttcttactgggaagatggaaaatgggtcgaagtcgaagctatgtctatcaagcgtgagtatgatttccctcaagttggacaaaaagatatgtatctccttcaccatgaagaaattgaatcattggccaagaatattccaggtgtcaaacgcattcgtttctttatgacttttggtcaatcatacttgacgcacatgaaatgtttggaaaatatcggtctccttcgtacggataccattaactttaacggccaagaaattgttccaatccaatttttgaaagccttgcttccagaccctgcaagccttggtccacgtactgtaggtaaaaccaatattggatgtatctttacaggtgtaaaagatggcgttgaaaagaccatctacatctacaatgtctgcgaccatcaggaatgttacgcagaagttggttcgcaagctatttcttacacaacaggtgttccagccatgataggtacaaaattagtcatgaacggtacttggaaacaaccaggagtttataaccttgaagaattggatccagatccattcatggaagctttgaatgagtatggtttgccttgggttgtggttgaaaatccacaaatggtggactaatgaagctagaacaagtaccaacgccagcctatgtcattgacttgcccaagttagaaggcaactgtcgtattttacaatatgtacaagaagaagctggttgcaaggttttgcttgcccagaaggcttattccctctacaaaacctatcccttgattagccagtatctatcaggtacgacagccagtggactctatgaagctaagctagctagggaagaatttccaggagaagtccatgtatttgcgccagcctttaaggatgcggacttggaggaattgctggagataacaaatcatatcgtctttaactcagagagacagttgcgtaaacatggggcccgttgtcgggatgctggtgtaagcgtgggtttgcgacttaaccctcagtgttcaactcaaggtgaccacgcgctctatgacccttgtgcacctggctcccgttttggagtaacttcagacaagataccgagtgatttgctggatttggtggatggtcttcattttcacaccctttgcgagcagggagcagatgatttagagacaactttgaaagcagtagaagagcaatttggagcctatttgcatcaggtcaaatggctcaatatggggggcggacaccacatcacaagagaggactatgatgtagatttgctgatttctgagatcaagcgtatccgagaaacttacaatcttgaaatctatatcgagcctggtgaagccattgcgctcaatgcaggttatctagcaactgaagtattggatattgtcgaaaacggtatggaaatcttggttttagacgcctctgcgacctgccatatgcctgatgtacttgagatgccctatcgtccacctttgagaaatggatttgccgctcaggaaaaagcccatacctatagactttcttccaatacctgtctgacaggagatgtgattggtgattatagctttgaaaatccagttcaaatcggtgatagactttattttgaagatatggctatttactcatttgtcaaaaataatacctttaatggtattggattgccaagtctctatctcatggatgagcagggtgactgcagattagtcaaatcttttggttatcaagactttaaagggagattatcatgatggacagtcccaaaaaattaggctatcgcatgccagcagaatacgagccccatcatggtacccttatgatatggccaactcgaccaggttcatggccctttcaaggaaaggctgccaaaagagctttcagccagatcattaagactatagcagaaggggaaagagtctatcttttggttggccaagactacttagctgaagcccaatcttatcttggagacaaggttatttatctagacattcccaccaatgatgcctgggcgcgtgatacgggtccgaccattcttatcaatgatgaaggccagaaattagccgtggattggtctttcaatgcttggggtggtgctgttgatggtctttatcaagattatgaagatgatgaccaagtagccagtcgttttgctgagaccttggaaatgcctgtttatgatgccaagccttttgtactggaaggcggagcgatacatagcgatggtcaaggaaccattctcgtgactgaaagttgcttgcttagttctggtcgcaatcctcatcttagtaaggaagaaatcgaaaccaccttattagagtgccttggagctgaaaaagttatctggcttccttatggtatttatcaggacgaaaccaatgaacacgttgacaatgttgctgcctttgttggtcctgctgagcttgttttggcttggacagacgacaaaagcgatcctcaatatgccatgtcagcagctgatttagcgcttttagaaaaggaaacagatgcaaaaggtcgtcagttcaccattcataaacttccaattccagctcttcatcaagttgtaaccaaagaggatttaccaggctacatctatgaagaaggagaagaagagcgatacgcaggtgaacgactagcagcttcctacgtaaacttttatattgccaaccaggctgtcctagttcctcagtttcaggataaaaacgaccaagtggccttagatatcctcagcaagtgttttccagaccgtaaagttgtcggaataccagccagagatattcttttaggtggtggcaatatccactgtatcacccaacaaatcccagaataggagaaaaagatgagaaatgtaagagttgcagccattcagatgcaatgcgctaaggatgtgtcaacaaatatccaaaccgcagagcgtttagtacgtcaggctgcagaacaaggcgcacaaattattcttttacccgaattgtttgaacgtccatacttttgtcaggaacgtcagtatgactactaccagcatgcccagtcggtgacagacaatactgccattcagcattttaaggtgattgctaaggaactacaagttgttttaccgatcagtttctatgaaaaagatggcaatgtcttgtataactccattgccgttattgatgcagatggggaagtgctgggtgtttatcgaaagacccacataccagatgatcattactatcaagagaaattttactttacgcctggcaacacaggtttcaaggtctgggatactcgctatgccaagattgggatcggtatctgttgggatcaatggttccctgaaacagcgcgctgtcttgcattgaatggtgctgaattgctcttttatcctacagccatcggttcagagccgattttggatacagatagttgtggtcattggcaacgtaccatgcaaggacacgcagcagcaaatattgttccagtcatcgcagccaatcgttatggattagaggaagtcgctccaagtgaggaaaatggtggacagagttccagtcttgacttctacggttcatcctttatgacggatgaaacaggagctattctagaacgagctgaaagacaagaagaagctgttctgttagcaacttatgacctagacaagggagcaagcgaacgcctaaactggggcttgtttcgagatagaagacccgaaatgtatcaatggattacggactagcaagcaaacctatatttacaaattttagaatatctgacgactgtcatgataaaaaaagcaaatagcagtaacctctgcctatttgcttttctttttataaaatatatttctcaatagcacgcgcaacgccgtcttcttcgttgcttgctgtaacggcatccgcaagagatttgacataatcactggcatttcccatagcaataccaaggcctgcaaactggagcatttcgatatcgttattagcatcgcccatagccataatctctgaggaatcaatcttcaaaatatctgctagtcgagaaagagcagtggcctttgtcgttccaagtggcatcgcttcataaatgacaggctgcgaacgaactccactaaatcgttggcaaagctcctcagcaaaacgctgctcaaaatcgtccgtttggctatctgtccccaaaaacatcccttgaaacatacggtacttgccactagtcgcttcctcaagagaaatttcagtcaggtctgaaaagaccagcttggcatcattttgaacaatttcattaggcttaccaccgaggacaaaataatgctcctcatcaaaaagagtcaactgaacatcacttttttcagctaggtcatagagatattcgatgtctgctggactaagttcttgccagtcaactagtccccagtcacttgtctggtgagttgaacaaccgttattgacaatgacatactcattctggaggtcgagtcccaattttttgtagtaggggaggacaccgaaaagcgggcgacctgtacagagaaccagtttgacacctttttcaatagcttggtgaatagcagtaatgtgagcttgtgggatttccttggcttcattgaggagggttccgtccatatccaaggctagtagtttaatcataggtcttccttctttttcttttggtattattatagcatattttggaggaaaggaggaggaatcttcgggctaatcatggtataataaaaggtaatgaaaaattctaacgaggcggagatgaaattactttatactgatattcggacttctttgacagaaattctaactagagaggcagaagagttagttgctgctggcaagcgggtcttttacatcgctcccaactctctttcttttgaaaaggaacgcgccgtgctggaatgcttgtcccagcaggcttcttttgcgattaccgtcacgcgctttgctcaaatggctcgttacctgattttgaatgatttgccagctaagatcagtcttgatgatatcggtcttggtatggccttttacagatgtcttactgaacttgatccaaaagacttacgagtatacggcgccatcaagcaggatcctcagtttatccagcagttgattgatctttatcatgagatgaccaaagctcagatgagttttgtggacttggagagtttgacggatgaggataagagagccgatttactcttgatttttgagaaagtaacggcctacctcaatcaagggcagttagctcagggaagtcagttatcccatttgattgaagctattgagaatgacaaggtaagtagtgattttactcaaatcgccttggttattgatggatttacccgtttttctgctgaggaagagcggattgtggacttacttcatgccaagggtgttgagattgttattggggcttatgttagtaagaaagcctataccagtccattctctgaaggcaatctctatcaagccagtgtggagtttctccatcatctagcctttaaataccaaacacctgcccaggattattctcaaactcatgagaagatggatagctttgacaaggcctctcgtttgctggagtcttcttatgacttttcagaactttccttggaaattgatgatagggaccgtgaaaacttacaaatctggtcttgcttgacgcaaaaggaggagttggagctagtagctcggagcattcgtcagaaattacatgagaactcaaatctgagttacaagcattttcgtattctcttgggggatgtggcttcttatcagttatctcttaaaaccatttttgaccagtaccagattcctttctatcttggtagaagcgaatccatggcccaccaccctttgacacagtttgtcgagtctattttagctttgaaacgctatcgtttccgtcaggaggatttgattaaccttctcagaacaggtttgtataccgaccttagtcaggctgatattgatgcttttgagcaatatatccgctatcttggtatcaatggcttgccagcctttcagcaagccttcaccaaatcccaccatggaaaatttgatttagggcgtttaaatgctcttcgtctgcgtattgtaacacctcttgagactctctttgccagccgaaaacaaaaggctgaaaatctcttacaaaagtggaatgtctttctaaaagaaggagcagtaactaagcagttacaagatttgacagctactatgaaagttcttgaacaggaaagacaagccgaagtttggaaggcattctgccatgttttagaacaatttgcgactgtttttgctggttcacaggttagtctagaggactttctagccctgctccattctggaatgagtctatctcaataccgtaccattccagcgacagtgaacaccgttctggtgcagagttatgatttgattgcgccactgacagctgactttgtctatgccattgggctgactcaggacaatttaccaaaaatcgcgcaaaataccagtcttttaactgatgaagaaagacaaagcttaaaccaagcgacagaagaaggcgttcaattgctgattgccagcagtgaaaacctcaagaaaaatcgctacactatgctttccttggtcaattctgcgcgtaagcagttgattctgtcatctccaagcctttttaatgaaagtgaaagcaaggagtcagcttatcttcaagagctggtgagttttggatttagtcgaagagaaaagagaatgagccataaaaatcttagcaaagaagatataggttcatatcacagccttttgtccagtctggttgcctatcaccagcagggcgagatgagtgagactgagcaagatttgacatttattaaagttctagcgcgtgtcatgggtaaaaaactagaccagcaaggtctggaaaatccagccctcccaaccagcccaagcagtaaacccttagcaaaggacaccttacaggctctctatcctgctgaacaggaattttacctgtctacctctggtttgacggagttttaccgcaatgaatacagttatttcctccgttatgttctaggcttgcaagaagaattacgcctgcgtcctgatgcccgcagtcacggaaatttcttgcaccgtatctttgaacgcgccttacagttgcctaacgaagattcctttgacaaacgtttagaacaagctatccaagaaaccagtcaagaacgtgaatttgaggctatttatcaggaaagtttggaagcccagtttaccaaggaagttttgcttgatgttgcacgaacgactggccacattctccgtcataatccagccatcgaaaccatcaaagaggaatcgaatttcggtgggaaagagcaagcctttattcaattggacaatggtcgcagtgtttttgtacgaggtaaggttgaccgcattgaccgattgaaagctgatggagcgattggagtggtagactacaaatccagtctgactcagttccaatttcctcatttctttaatgggcttaattcccaactgccaacctatttagctgccttaaaaagagaaggggagcagaacttttttggtgccatgtacttggaaatggctgaaccagtccaatctttgatggccgttaaaagtctggcaggtgcagtagtagaagctagcaagtctatgaaataccaagggctctttttagaaaaagaaagcagtcatttaggtgaattttacaataaaaataaggccaatcagctgacggatgaggaattccagcttctactggactacaatgcccatctttacaagaaagcggctgagaagattttagaaggccaattcgccattaatccttatactgaaaacggcagaagtattgcaccgtatgttcagcaacatcaagccattacaggatttgaagctaattaccatttaggccaagcccgtttcctagaaaagttggacttagctgatggcaaacgtctggtcggagaaaaactcaagcaagcttggtttgaaaaaataagagaggagttgaatcgatgaagcccattccctttttaactgaggaggaaattcaaaaactgcaagaagcagaagcaaattcgagcaaggaacaaaagaaaactgccgaacaaatcgaagccatctacacttctggtcagaatatccttgtctcagcgtcggctggttctgggaagacttttgtcatggccgagcgtattctggaccaattggcgcgtggtatcgaaatttctcaactctttatctcaacctttaccgtcaaggctgcgactgaactcaaagaacgcttggagaaaaaaatcagccagcaaatccaagaaacgcataatgtcgatctcaaacaacacttgggccgccagttggcagacctacccaacgcagccatcgggaccatggactctttcacgcaaaaattccttggtaaacatggctatctgcttgatattgcgccaaatttccgtattttacaaaaccaaagcgagcaacttcttctaaaaaacgaagtctttcatgaggtatttgaagcccattaccaaggcaaacagaaagagacctttagtcatttgctgaaaaattttgcagggcgtggcaaggatgaacgggggctgcgccagcaggtctataaaatctatgacttcctccaatccaccagcaatcctcagaaatggctgagtgaatctttcctcaaaggctttgaaaaagctgattttactagtgaaaaagaaaaactgactgagcaaatcaagcaagccctttgggatttggaaagctttttccgttatcatctgggtaatgatgccaaggagtttgcaaaggctccctatttagaaaatgttcagttgattctggatgaaattggctccttaaatcaagagtccgatagtcaggcttatcaggcagtgcttgcgcgtgttgtcgcaatttcgaaagagaaaaacggtcgggccctgactaatgccagtcgcaaggctgatttgaagccactggcggatgcctacaacgaagaaagaaagacccagtttgctaaactaggacaactgtcagaccagataaccattctcgactatcaagaacgttatcatggagatacctgggaactagctaagactttccaaaccttcatgagtgattttgtggaagcttatcgtgaacgtaagcgtcaggaaaacgcctttgaattcgctgatatcagccattacaccattgagattttagagaaatttcctcaaggccgtgaggcttatcaggatcgcttccacgaagtcatggtcgatgagtatcaggataccaaccatattcaagaacggatgctggaattgctgtctaatggtcacaatcgctttatggtgggagatatcaagcagtccatctaccgtttccgtcaggcagacccgcagattttcaatgagaaattccaacgctatgcgcaagattccaaagaaggaaagctgattctactcaaagaaaatttccgtagtagttcagaagtgctatcagcaaccaatgatgtttttaaacgtctcatggaccaagaggtcggtgaaatcaactatgacagcatgcaccaacttgtttttgccaataccaaactgactcccaatccagataacaaagcagaatttctcctctacgacaaggacgatacaggtgaggaagaagagagtcaaacagaaacgaaactaacaggcgaaatgcgtctggttatcaaggaaattcttaaactccataaggaaaaaagtgttgcttttaaagaaattgcccttctgacctccagtcgcagtcgtaatgaccagattctccttgccttgtctgagtacgggatacctgtcaaaacagacggcgagcaaaacaattatctccaatccctagaagtgcaagtcatgctagacactcttcgtgtcattcataatcccctgcaagactatgccttggttgctctcatgaagtctcctatgtttggatttgatgaggacgagttggcacgcttgtctctccagaaagcagaagataaagttcaagaaaatctctatgaaaaactggtcaatgctcaaaaacaagtagctagccagaaaaacttaattcatacggatttaactgaaaaactaaatcaattcatggatatcttggcttcttggcgtctgtatgccaaaactcactctctctatgacttgatttggaagatttacaacgaccgtttttactatgactatgttggagctttgccaaatggccctgctagacaggccaatctctatgccctagctcttcgggctgaccagtttgaaaagagcaatttcaagggcttgtctcgttttatccgtatgattgaccaagttttagaagcccagcacgatcttgcaagcgtggcagttgcaccgcctaaggatgctgtagaactcatgaccattcacaagagtaaagggctggagtttccttacgtttttattctcaatatggatcaggacttcaataagcaagacagcatgtcagaagtcattctcagtcgtaaaaatggactaggtgtcaaatacattgccaaaatggagacaggagcagtagaagctcactatccgaaaaccatcaagctctctattcctagcctgacctataggcagaatgaagaggaattacagctggcaagctactcagagcagatgcgtctcctttatgttgccatgacgcgggctgagaaaaagatctatcttgtcggcaagggttcgcgtgaaaagctggaatccaaggaatacccagcaactaaaaatgggaaactaaatagcaataccagactgcaagcaagaaatttccaagattggatctgggctatcagtaaagtatttgccaaggatcatctcaactttagctatcgttttgttggcgaagatcagttgactagagaagctatcggtgagttggaaaacaagagccctctacaagatagctctcaagcagacaatcgccagtctgaaaccatcaaagaagcactggaaatgctgaaagaggtggaagtttataatactcttcaccgcgcagccattgaactgccaagtgttcaaactccaagtcaaatcaagaaattctacgaaccagttatggatatggaaggtgtcgagattgcaggtcaaggccagtcagtagacaagaaaattagctttgagttaccagatttttcaaccaaagaaaaggtaacaggagctgagattggtagtgctacccacgaactgatgcagagaattgacctcagtcagcgaccaacccttgctagcctaacagaaactctcaaacacgttcaaaccagcccagctgtcagagacaagatcaatcttgctaaaattcttgcattctttgacacagcactcggtcaggaaattctctctaataccaaccatctttatcgcgagcaacctttctccatgctcaaacgagaccaaaagagtcaggaagactttgttgtccgtggtatccttgatggctatctgctttacgaggacagaattgttctgttcgactataagacagaccgctatgatgaaccaagtcaactcatagaccgttatcgtggtcagttagccctatacggagaggctttatctcgagcctattcgattgaaaatattgacaaatacttgattttactcggtaaagacgaggttcaagttgtaaaagtataatctagaaaggagacctcatgacacttccagttagaaaatccctgcatgatgcggttttacaggcttcaaaagctgatacttgggaacaagctaccaaggaatggaatgaagtttccttgatttttaacggtatcggccgtagcaattgtgtctgtggaaatgccatcaaatacgcctacgaactctttaacggagtgactggtcaacgactatttcctataggtagcgactgcgttcgtcattttcatcgattgtctcttgaccagcaattggaagaggaagaaaaactgctaagaaaggttgaaaatctaaccagaaaagctcagaaaaaggaaaaaatcaaggtcaataaaagtgactttgacgagcgacttctaaaatggctctgggaaaaaggtgttttcaaacccaatcgtggcaatcaatttgcgcctgagagagactaccagcttttcctagaagtctttcagggaggaagttggaccaaggcagagcctaagaagaaggctcggatggaagaagtccttgaaaagtgtatcaaaccctttttacttggcaaaccggatgaccaactctaccttgtcaagctaggcaaggagaaaattgactacgagcaagaactccgaatccaagcagagaaagagcgcaaaaagagagataaaatcgccaagcaatatgcagacaatctggtcctagccatgggcccagcagagcgcgcttatcaagattactttggctttacagaaaccctaactcaagaagaacgtaagtgggagaaaatactttttggtaaaaatagaacagaacgggctatcaaggccaaacaataccaaaaagagctggaaaaagaccaacgaattgctagtcaggatccaattgaaagaaagcagaagcagacctggctcctcaattcctattttcgtgagcttcctgaagaaaaagctcgattttctaggctcttattagaatatcgaaaaagtggagaagttcccttttcaaccgaatatctgtcagatcatcttattgactttttctataaaatgaaagcctttgagtttgaaatcgcaccagaacaagttcgagattttataaaagaaagcctccaggcagaacatctctcatcagcacaggaatgctggatagaagggattctaacaaattgcatagtcccatttttatctcgaatactcatctaaaactaaatatataagtcttagaattttatataaagttaatatataaattaagtggggttgaaatcagtcttcctttaaaaagtagctattacaaacaaaagcttatgcaaaaaagactaatttatgatagaatagaggataagaaagaaaacgtttttacaattttttcaatccgaaggagatatattatggctactattcaatggtttcctggtcacatgtctaaagctcgtcgacaggttcaggaaaatttaaaatttgttgattttgtgacgattttggttgatgcacgcttacctctatctagtcaaaatcctatgttgaccaagattgttggtgataaaccaaaactcttgattttaaataaggcagacttggctgacccggcaatgaccaaggaatggcgccagtattttgaatcacaaggaattcagacgctagctatcaactccaaagagcaagtgactgtaaaagttgtaacagatgcggccaagaagctcatggctgataagattgctcgccagaaagaacgtgggattcagattgaaaccttgcgtaccatgattattgggattccaaatgctggtaaatcaactctcatgaaccgcttggctggtaagaaaattgccgttgtcggcaataaacctggtgttaccaaggggcaacaatggcttaaaaccaataaagatcttgaaatcctagatacaccggggattctttggcctaagtttgaggatgaaactgtagctcttaagttggctttgactggagctatcaaagaccagttgcttcctatggacgaggtgaccatttttggtctcaattatttcaaagaacattatccagaaaagctggctgaacgcttcaaacaaatgaaaattgaggaagaagcgcctgttattattatggatatgacccgtgccctcggtttccgtgacgactatgaccgtttctacagtctcttcgtgaaggaagtccgtgatggcaaactcggtaactataccttagatacattggaagacctcgatggcgacgattaaagaaatcaaagaactccttgctactgtcaaggaccttgatagccctattattttagatcttgaaaaggataatcgctctggaattcaaaaggaaatcagcaagcgtaaaaaagctattcaggcagaattggatgaggatcttcgtttgaaatccatgctttcctacgaaaaagaactgtataagcaaggattgaccatgatagcaggtgttgacgaggttggtcgtggtcctcttgctggtcctgtagtcgctgcagcagttattttacctaaaaattgtaaaattacaggcctcaacgacagcaagaaaattcctaaaaagaaacatctggagattttccaagcagttcaggaccaagccttatcaatcgggattggtatcatggataatcaggtcatcgaccaagtcaatatctatgaagcaaccaaactggccatgcaggaagcaatctctcagctcagtcctcaacctgagcaccttttgatagatgccatgaagctggatttacccatttcacaaacatctatcatcaaaggagatgcaaactctctctctatcgccgcggcttctatagtagccaaggtgacacgtgatgaattgatgaaggaatttgaccagcaatttcccggctatgatttcgctgctaatgcaggatatggaacagctaaacacctggaaggactgaaaaaaataggagttacccctattcatcggaccagctttgaacccgttaaatcgctggttttaggagaaaaagaaagttaaattagaaggaatgattatggaggaacagtcagaaacactcagttccaagaaagaatttgcctttgcctcgagtaccatattatcccaagttggacgaggaatcattgttggtctcgttgttggaattatcgttggatcctttcgtttcttaatcgaaaaaggtttccacctgatacaaggactttatcaagatcaagcgcatctagtgcgcaatctttttatcattggtctattttatttaatagtttgttggctcagtgcgaaattaactcggtcagaaaaagacatcaaaggctcaggaattcctcaagtcgaagccgaattaaagggactcatgactctcaactggtggggcgttctttggaaaaaatatattttaggaattcttgctattgctagcggtcttatgctggggcgagaagggccaagtattcaacttggagcagtcggtggtaaaggaattgccaaatggctcaaatccagtccagtagaggaacgatccttgattgctagtggagctgccgctggtctagctgcagcctttaatgcaccaattgcaggtcttctctttgtcgtagaagaagtctatcatcacttttctcgctttttctgggtgtctactctagcagctagtctcgtagcaaactttgtttccctactcatatttggtctgacgccagtgctggatatgccagataacattcctctcatgaccctggatcagtattggatttacctccttatgggagtttttcttggactatctggttttctctatgagaaagctgtacttaatgttggtagtgtttatgattggcttggtcaaaaaatccatttggatagagcttattacccaatttttgcctttattctcatcctaccagtcggaatcttcttaccccaaatccttggtggtggaaatcagctggttctttccctaactgagcaagattttagttttcaagttctattagcgtactttttgattcgctttgtttggagcatgattagctatggaagtggcctgccaggaggaattttcctaccaattttggcacttggctccttacttggtgccctagttggtgttatttgtgtcaatcttggacttgtcagtcaagagcaattccctatatttgtcattctaggaatgagtggctattttggagcaatatccaaggctcccttaactgctatgatactcgtaactgagatggtaggagatattcgcaacctcatgccacttggtttagtaaccttggtcgcctacatcatcatggatctactcaagggggcgccagtttatgaggctatgttggaaaaaatgctacctgaagaagcgtcagatgaaggagaagtcacacttattgaaattcctgtatcagacaaaatcgctggaaaacaggttcatgaactcaatctaccacacaacgtcctcatcacaacacaagtccataatggtaagagccaaacagttaacggctcaaccagaatgtatctcggagatatgattcacctagttattccaaaaagtgaaattgggaaagtcaaagatttgttgttgtagtgatttttacataatttatgttatgtaaaaaataaacttcttaattaaatatattagaaaaccgattctcagcaatgagatcggttatttttacatataagatatttcacgtacaaataattgagctttggaaaaataagactataattaagttagaattgataatgcataaagctagaaaggagtttactgtataaaatctgtacagtaagattaaaatcatgaaaaagaaaacaatagcaattatacaatgtattttgtatcccatagctccttacacagctcttcagttaagtagaatgaacagaagtatcgttactgataatctcttttttattttccttattctgttgactatttcattctggtttagtatttggaaactagaaaaagcactagataatgattcacaatgaaactgcaaagatttaaatccattttacgcaaaaactggaaaattttgtactttttcctaaacagtggataagcccttgatacaactgggtttaagacgtaaagtacactctctaaaaattgtactttataattgaaatgtactttattttaaggcaagataaagtacattttcactaaactaaaatgaacatttgaaaaatttcagtttttactttgataacgtacatttttagctatttttgttcaaaaaaatttttttagtaattgggacgatttaagtcttttttatcacttttaaaaaaactctatgacatctttctgaaaaactataattttcttgaaaaataaataagtctatgctatactactagtagacttatttatggagaaaatacatgaaacgtgagattttactggaacgaatagacaaactaaaacaaatcatgccctggtatgttctggaatactatcaatctaagctagctgtaccttacagttttacaaccttgtacgaatatctcaaggaatacgatcgatttttcagctgggttttagagtctgacatttcaaatgctgataaaatgtctgatattcctttatctgtcttggaaaatatgtctaagaaagacatggaatcttttatcctttatttacgtgaacgtcctttgctgaatgctaatacaaccaaacaaggagtttcacagacaactatcaatcgaaccttgtcagctctttccagtctttataagtatctaaccgaggaggttgaaaacgatcagggggaaccttatttttatcgtaatgtaatgaaaaaagtttcaaccaaaaaaaagaaagaaacgcttgctgccagagctgaaaacatcaagcaaaaactctttttaggtgatgaaacagaaggtttcctaacttatattgaccaagagtatccacaacaactttcaaatcgcgctctctcatcattcaacaaaaataaagaacgtgatttggccattattgcccttctattggcgtctggtgtccgcttatctgaagctgttaatctggatctaagagatctcaatctcaaaatgatggttattgatgtcactcgaaaagggggtaaacgtgactcggtcaatgtcgctgcctttgctaagccttatttagagaattatttggccattcgaaatcaacgctataagacggaaaaaacagatacagccctttttttgactctctacagaggagttcctaatcgtatcgatgcttccagcgttgagaaaatggttgctaagtactctgaggacttcaaagtccgtgtaacaccccataaactacgacataccctagcaaccaggctctatgatgccactaaatcgcaagttttggtcagtcaccagctaggacatgccagcacacaagtcactgacctctatacccatatcgttaatgatgaacaaaagaatgctctagacagtttataaaatacataaaataaattatgtaatatatggtttttaaaaaagaagctggtcctacaaccaacttctttttgatttatccaactaccgcttcagcgatttcttcacggctaataccagcgaaatagcgtgtgatatcaatggtttctaacgccttaaggacatcttcgcgttcgtatttcaccccacgaaggacatcttctactgcagcaacatcttcaataccaaagaagtcaccgtaaatcttgatgtcttggatttttgattcgagaacattagcaaagacttccaccttaccactagtgaattttgttccacgacggacgttaaattcaggtgatttaccatagttccagtcccaagttccaaacttagtatctttgatacggttaatttcagctagttcttcctcagaaaaaacgtattctgtcatctctggatactcttttttcatgtattccaagagtaagtcacggaattcttcgactgtgattttttctggtaattcattgataatattggttacacgagcacgaaccgatttcacaccttttgattcaaatttatcttttgaaaccttaagggcatttgctaggactgacaaatcaacgtcaaagagcaagcaaccatggtgcatgatacgaccgttgatataggcttgagcattgccacagaatttctttccatcaatctcaaggtcattacggcctgtgaactcagctttaaccccaagttgagccaaagtattgataactggagttgaaaaactcttgaagtcaaaagctttgttttcatcttcttttgagatgatcgtgtagttgaggttatttaaatcgtggtaaacagctccaccaccgctgatacggcgaactacctcgatgccattttcgcgaacataatcacggttgatttcttcgatggtattctggtgacgaccaacaatgatagatggcttgttaatccaaagtaggaaaatttgatcctcatccaaaaggtgtttaaaggcgtattcttccaaggcaatattaaaggcagtgtcgtttgaatgattgataatgtatttcatgatatccctttatacgatagagactggaaaacacctttccagtctaatctatctttcttttattttttcttaggtgaatggatggccattcctaaaacatccgcaaatgcttcgtacatcacttcagagtaggttgggtgtccgtggatagtcttcagcatttcttcaacagtaatttccatttcgataatgctcgatgcttcattgatcaattctgcagctgcaggaccgatgatatgaacaccaaggatttctccgtatttcttatccgcaataactttaacgaaaccttgagctgcatccgatgcaatagcacgaccgttagcagcaaagttgaacttaccgatggctacatcgtatttctcacgggcttgttcttctgtcaaacctactgctgctacttcaggaagagtgtagatagctgcaggagtcaaattcaatttggcaacagcatgatttcctttaagggcattttcagcggcaacttcacccatacggaaagctgcgtgagccaacatcttagtaccattaatatcacctggtgcgtagatacctggaacagaagtttccatgtattcgttgaccttgatacgaccacgatccaattcaaactcaacctctccaataccttcaaggtctggcacacgaccgattgaaagaagagctttatttgcaatgatatcgtcttttccttcaactttaatacgaagttgaccattttcttcgatgatttcttgcagtttagtaccagtcaagatggtcattcctttacgttcaaggatcaagcgaaggttcttagaaacttctgaatccatagctggcacgatacgatccatcatttcgataacagtcacttttgaaccaaatgtcatgaaggcctgaccgagctcgataccgacaacaccaccaccgatgataacaagactttctggtacttcgttcatttcaaggatgtcgtcgctggtcatgacaagtggagattccataccagggatgttgatcttgctgacttttgaaccaccagcaaggatgattttcttggtttcaagtaattcagagccatttaccaagacgttcttgtctttagtaatggtaccaattcctttatgaacagtaactccgtagctacgaagaagaccagcaactccaccaaccaaagtattgactaccttagacttggtttcaaggagtttgtccatatcaacagtgaagttaggattttcaatcacaataccacgatttgcagcatgaccgatattttcaataatttcagcgttatgtaggtaggttttagttgggatacatccacggttcaagcaggttccaccgagttcagatttctcaacaagggcaaccttcccaccgagttgggcagctttaatggctgcaacataaccagcaggacctccaccaatcacaacgatatcaaaagcatcatcgctcttaccatcatcgtttgaagcacttgctgtaggtacagggctagcttctggcgctgctgctccagctgttgggatattttccccttcttcgccaaggtaaccgataacttccgttacagggactgtttcaccgtcccctttgaggatagcaatcaagtacccatcttcttcggcttccaattccatgctgactttatcagtcatgatttccaaaaggatttctccttcttttacaaattctccgacttttttattccattggacgatttgtccttctgtcatatccacgccggcttttggcataattacttctaaggccatgtcttccttcctttatctatatcttaaaaatgaatactcttgtacttaaatcaacattgagattggattttcaatcaattctttcaagtctttcataaacttagcaccagccataccatctacgacacggtggtcaattgttaaaccaaggctcatgattgggcgaatcacaatttcaccattgactacaactggcttctcgattgtcgaactcacaccaaggatagctgagtttggttggttgatgataggaccaaaagactgaacaccaaacattcccaaattactgattgtgaaagttgaattttgcagttcgcttggagctaatttaccatccaaggtacggccaataacatccttgaaggctacaaccagttctgaaagactcatcttctcagcattgtaaacaacaggtgtcattaatccattatccatcccaactgccatggcaagattgacatagttgtgagtgataatagtcttgccatcttctgtcaatgaagcgttgatgtatgggtgtttcataagagtcttaacaactgcaagtgaaagaaggtctgttacagtagtcttcttcccagttgcttccatgattggttcaagcaccttcttacgaagagccaacatttcagtcatatcaacttcatagttgagagtgaaggttggcgcagttaggtaagattcaaccatccgttgggcaataaccttacgcattggtgtcattggaatacgctcaatttcaccgtatggtgttacgttatcaggaacttcttccactttttcaatctgagcaggagacttgatggtgtcgttttcgatattttcaggaagcaaggccaaaacatccttcttcatgattttaccacgatgaccagttccttggatttcctgccaagcaatgttatgttcgagggcaattcgttttgcaagtggcgaaatgcgaaccacatttgtgtctttataagtttccacgtcttctttgtggacacgaccgtttgcacctgagccagaaacgtcgtagaggttgatccctaaatcatccgctaactttctagccgcaggagtcgctcttagcttgtcatcagccatgacctctccaattctatactaagatattaaggacgaagagctccgtacctaaaagatacaaagtttctcgtcagctttattttgtttacataacttatcttatgtaattctattctttgttatatgttttacgaatggcatctttgatgctttcaacggttggaatcattgcattttctaggttttgtgcataaggcattggcacatcttctcctgcgcaacgacggattggtgcatctagatagtcaaatgcttctgattctgaaataatagctgaaatttcaccgatatagccgcttgttttatgggcatcgttaaccagaacaactttaccagtcttcttaactgagttaatgataatctccttatcaagcggaacaagggtgcgtgggtcaacaatctcaacagaaattccttcttctgctaattcttcagctgcttgaaccacacggcgaagcatttttccataagtaacaactgttacatccgtaccttcacgtttgatttccccaactccaagtggaatcgtatagtctggatcaactggtacttcccctttttggttaaattctgacttgtactcaaggataataacagggttgttatcacggatagaagacttaagcagtcctttcatgtccgcaggcgtacctggtgctacaaccttaagtcctgggatatgagtgaaccaagactctagagattgtgaatgctgggctgcagaaccaactccgttaccagctgcacaacgaacagtcattggaacctgacctttaccaccaaacatgtaacgtgttttagcagcttggttgacgatattgtccatggcaataaccgagaagtccatgaaggtcatatcaacgattggacgaagtcctgtcatggctgctcctgctgctgctccagagatggcagcttcagaaataggacagtcacgaacacgttctggaccaaattcttcaagcattccaacagaagttccgaagtctcctccgaagacaccgacgtcttctcccatcaagaacacattttcatcgcgacgcatttcctcagacatagcaaggataatggtgtcacggaaggacattgtttttgtttccattttatctctttctccttagtctgcgtaaatatcttcaaaggctgattcaagcggtgggaatggactttcttctgcaaatttaacagaagcttctactgcttccttgacttgcgtttggatttcttccaattcttcggcacttgcaatagtgttttcaatgaggtacttgcgaaggttttcgattgggtctttttgtttccacaattccacttcttcgcgggtacgatatttaccagggtcagatgatgaatgaccaagccagcgataagttacactttcaatcaagactggaccattgccaccacgaacatgatctacagctttcttaaatccttcatagacatctatgacattgttaccgtcttcgatgaacattccaggaattccataagcagcgctacgttgatggatatgcttcacattagtcattttcttgatatccgcagagataccgtaaccgttgttgatgcaatagaaaatgactggcaggttccagatagaagccatatttactgcttcgtggaaaacaccttcgttggtcgcaccatctccaaagaagcagacaacgatttttccagtatgttgcatttgctgactgagggctgcaccaacagcgattcccataccaccacctacgataccattggcaccaaggttaccagcatcaagatcggcaatatgcatagatccacctttacctttacaggttccagtgtatttgccaaggatttcagccatcattccgttgaggtcaatccctttggcaattgcttgtccgtgaccacggtggtttgatgtgattagatcatctggattgagagccaacatagcacccacgttagcggcttcctctccaacagaaaagtgcgtcattcctggcactttccctttctttactaattgcgcaatttttaagtccatacgacggatttcttccatcttacggaacatctctagcaaaagatttttatctaaaattgacatcttcttgcctttctaactttcttcttaccttactattttaccgtttttggcaaatactgtcaaagtttttctaaagaaaatttcacaaattaaaaaagaaaaccccatagaaataagggattttcttatcaagaatattttttcacaaactttttagcgtttagatttttctaaagattcaaatctcttcataatcacagttaaacgccaacggtagagaaccccactcacaaccaaactaataatcaagccgatccagtaagaataggctccaaaatctgttagggaatcaaataccatagctactgggagtgtcaccccccagtaaccaaccaaaccaaggcaaaaaggaataacggtatccttatacccccgtaaaattccctggagcggtgctgcaaaggtatctgctaactggaagaaaagactataagtcaaaaagcgcgctgtcaaatcgataaattctgggtcgttaccataaagactagccacatttcccctaaaaatgtaaaggaaggttaaggtgaaggccgcaaaaacgagagctacacttcttccaatatgaataaattttttggcatcttggaaccgtttagctccaagttcataagatacaacaatcgccatagcggaagaaatactcataggaaaggcgtacatgagtgttgaaaaattcatagcagattgatgactggctataatgagcgatgaaaatttagccattaacaaaccaactacagagaaaacagctacttcagcaaaaactgttcctcctattggcaaaccaagtcggacaccttcctttattctttcaaaatcaagaggggtgattttggaaaactgatattcttttagcttcttattctttatcaaaatgaaaattgaaatggctagaaggcaccaataagctagagatgttcctaaaccagctcctgctcctcctaactcaggcaagccaaaaactccataaatcaagagatagttaaagccactatttaaaggaagcaacaaaagcatcagatacatggaaagttttgtcaagcccaaggaatctaacaaggaacggataacactaaaaagtaggagagggataattccgatcgctaaaaactgtaagtagtgtacagctactgctgctacctttggttctaagccaatatgattcaaaatcggtggggctaggaaaattaccaatccaaataagaagatagaaagtcctaaagctatataaataaactgataaaaatctgaagcaacttcttccttttttcctctacctaaattgtgtccaataatgggaatcatagcatagacgatacctgtcaaaaatgtgaaaaaagggttccataaactagttgctgtagagacaccagccaaatccatggtattgtattgaccagtcatagtggtatctacaaatgaagcggaataattggcaaattggtagatcataatcgggaagaatatcttaagaaataagataaacttgtctttaaaacgatgagttggatacataaaaagtctctattctttaacattatagagcaggattccaactagttttcatagacaatttgtcctttacagatggtatatttgacctgcccttttaaggtttcaccgataaatggtgaattggctgctttagaagcaaaatgtgaatcaacaagacggtcagccttggcatcaaaaatagtaatatcagcaggaccattttcagctaggtagcctgcttcaaagttatatagttttgctggattgtatgtcattttttcgagtaattccatcaaactcaactccccagcttccaccaaataagttaaacctagagaaagagatgtttccaaaccagtcataccagatggcgctttggtaatatcttcgacatttttttcatccgcatggtgaggcgcatggtcagtcgcgataactgtgatgacgcctgacttgagaccttcaatcaccgcacgacggtctgattccaagcgaagcggtggattcatcttagcattgctaccttgtgtcaaaagaagtgcttctgtcttagagaaatgctgtggcgctacttctgctgtgacttgcgcgcctagcccttgagcaaactcaactactttgacactttcttccttagacaaatgctgaatatggacatgagccttagttgcataggcaatcatgacatcacgcgccatcatagcgtactcagccaccccagtcgcaccgcagatatggaaatgttctttagcgatattttcattaaagccaagaacaccgttcaaacctggatcttcctcatgaagactaataaaggtattaagctttttagcttcctccatggcttccttgacaactttactgctctcaagcggaataccgtcatcagaaaaaccaacagctccagcttctaagagtgctttaaagtcagtcaaatcttgcccattaaaattcttagtaatggtcgcaaccgtcttaacattaatcttctctttggcagctgactggagaacttcttgcaaagtctccacgtctgaaatggttggactagtattagccatcatgacaaccgtggtaaaaccacctgcagcggctgctagggcaccagtatggatgtcttccttgtgggtctgaccaggttcacgaaaatgaacatggatatcaaccaagccaggagcaactacaagacctgtggcatccaggatttctgcgccttcttctttaatttcaggcgcaattttgataatctttccatcttcaaccaagacatcacacacttgatccaaaccagacttgggatccattacacgaccatttttgattagtagcatctgctttctcctttattcataaaaatcaacttgggtatccaacaatttatccccatcataaacaaacttagctgaaaagaagggtttgtcctctaaaagccactcaacaaaggtatggtcaccttcccaagtcggcttgctcaaaacctcatcataaggaacccattccagcgtcccctcattgcagtcaatcaaatccccctcgaactccgtcaccttaaaaacataggtgtaccagtctaaatctggtgtaaattcaggaaaagtgatgacaccttttagaactggcttggctttgagccctgtttcctcaaggatttcacgcgccgcgcattcctgaggtgtctctcctcgctctagcttaccacccacaccaatccattttccttcatgaacatcatttggcttcttattacggtggagcataagcagttctttcccgttatcaatgtagcaaatcgtcgctaactgaggcatattttctccttatctaagccaatcgattggctcttgtcctgtttcttttaagaatgcattggccttggaaaaaggcttggaaccccaaaatcctctataaactgacaaaggactgggatgggctgattcgataatcaagtgatgaggattggtaactaaggccttcttcttgcgtgcataagctccccagagtacaaaaacgacttgtctatctagatgattgaccacctgaatcacagcatccgtaaaaggctcccatatctgcccagcatgaccattagcccgtccagccggaactgtcaaacaagcattaagaagtaagactccttgctcagcccaagctgtcaaatcatgagatttcttaaccccgatatcatctgacaattctttcaagatattttgcaaggatggtggagctgggatagagtccggtacagaaaaactcaagccctgcgcttgacctggcccgtgatagggatcttgccctagaatcaccaccttaacttcttcaagcggtgttgtcaagagagcctgaaaaaccttttccttgggtggataaatagtcccctgagcatagacctgattcataaactgattgattttcccgaaataaccctcaggtaattgctccttaatcaaagcatgccaagacgaatgttccatagccgactccttcgtttttactgcctctattatagcaaaaagtggctttctaaaccactttttacagtttatctaagcaatccagcaagtcttggtaagaatggatttcgtaagtcggctgggcttgtgtgggattttcgaggtgatgaggattgtaccagatagtgtcaatccccgcattattgccaccttgaatatcggcggttagggaatctccaaacatcaacgtcttttctttactaaaacctgcaatctgttgaccaatcttttcataaaagagagcatcaggcttttgtgtttgcaattgttctgagataaagacttgattgaaataaggtgccagaccagattgagccaaacgtcccgtctgaatagcagtaatcccatttgtcgcagcatataagtcataatcacgctcgatgaggctatctaaaagttcatgagcacctgaaaaagcttgcccttgctgggataggtaaaactggtaacgttgggctagaaaactaccgtctttttcctgtccaaaatgagcaaataaacgagaaaagcgcgtgttaaccagctcttgtttactaattttcttttgctccaaatccttccagagagccttgttcatgggaacgtaaaagtctttgtaggcctgaatatctgcaaccccttcttcttttagaagttgcgtcaaagccacatcctcagcagcatcaaaatcaagaagagtgtggtcaaggtcgaaaagtagaaatttgtaggacaatttgagagttttcctttctaggtacttaatagattagtttatttcttctttttcttagttttattcatcaacataccaactacaactggagtaaccacactgccaacttgtccaacaactttaagtatcttttttgcttcatctatttttttgtttctacacgattcgcacttattgtgcttataacttgatggtaaatccctagtacatgtcttgcatttttttatttctttcattctagcacctctgtctcaatagaatctgttttatttggcaatttcattatagaagtttcaatttttggcaattcttttgtccagtaatttgtaggcgaaggatcaagtaaatcaagtctctctactaattcctgagaactgagataagtttcgttaataaatttcccaaagtaatccaaacttttttgagcagcttttttctcgcccaactcattataagctattgctgctgatagtgaaacgatatttacagctgctaatccatctcgaatctcattcatacgagcttcaattttatctggtttatccccttttaataacttaccccaagtagaatctggttgttctttgataaaatttacatttgatttttgactaagcattaagagatttctactatcttctgcatctgaaataacttgcagtaacatcattgttctaatatttggatctgatatctctctagcttgcaagagtttctgttgacaactataggctattgcaagtctatctgactcctgtccttttctgacgtcctcaatagcatattgtacattttgaatctcctctgcaatctgagccatttgaatttgtgacgaataatcagctaacgctttatttaattctggtgtcaatttaacagatttcaatggtacatttccaatgactttattagtattagtatctactaataccgccaagagagagccatctttcttggtcattaattttaacactccttgagcaattgcttcccgttgttctggagaaagaattgcctgaaaaacctcttcaggtatactagattggacaacattgataaaggctggagcagaatataacattttttctacttcagataagattttattagcatttttgactaaaggtttggctatttctggtaacttattaaaaaatgctgagggttttagttcatagccatcaatatcaagaatatcgaagtcatcttctccaaaaaataaaacttcatccataaattactacctcattatgtttaaattattagaaatattataccatattaaacaaaattatgattttgatttttctttaatattatttatccaatcatttttactggaatctaacatagaataatactatcctatacaattgacagctcaaatctttcagaatagaacaatcctaactatcgaatactctaacttcataaatatctatgcaattctagatctagaattcctataaactaaatgttttcgcactcttctaaaacattgattgccttaaattttaatttttgaaggattctaaagctagaatagtcccatcacaatcagttttgaattattatactcaatgaaaatcaaagagcaaactaggaaactagccgcaggctgtacttgagtacggcaaggcgacgttgacgtggtttgaatttgattttcgaagagtattaacaatttagaaacgctatgattccactccttttacattaaaaaggaactgcataaagcaatccctttctgattttgaaattatttacttaaaatttgatagttgagataatcaataactcacctataaaagaaatgataggatgattccttatttattgatttcaagctccgacaactgtgtttgaataactgacagttctgcaccagcctgaagaagagcagctgcagtataggcaccttctacaattggaaccctattgatcatgatacttttatcactgaaatcagccaccatttctaagttcattttagcagaacctaggtcaaaaaaagctaataaagtatctgctggattttcggaaacaaccctatctacttgatcaaaactcgttccaattcctccatcttcggttcctcctacataagtaatcggaatatctttagctacttcactaatcagttcaacgacaccttgtgcaatgtgtttagaatgtgaaacgataacaagaccaatacttcccattaaaccaccccagtttctaaaagagcagtaaagagtaatcctgatgaaaatgatccaggatcaatatgtccaagagaacgttctcctacataagatgcccttcctttagttgcaagtaaatctttggtagcattcactagcttatcaataacctcttgagtcaattggcctgcagacaaagcagcaataacaggagtccaaacgtcaaccattgtcttttctccaacttctgctttcccacgtttgacaatcatatccaaaccgctttgtaagatttcctctattttcgaatttgaatcagccttggccatgcccataaaagcagagccatacaagggaccagaagcaccgcctaccttgctcagtaattgcattgagacaagtttaaacacatcactgcttgtttcaaattgctttccttctaagttttccataactgcagccattccacgcgccatatttccaccgtggtctccatctcctataggggtgtctagctcactaaggtaatctttctgttcttgaatcttttcattaaaaagcttcatccattcaagagcttgttcaacattcatgcgacatatcctccttgagttttaccaagctggggtagtaacaggtgtatttagagcatccaaccactcatcatctgccaatcgaatcaatgttaatgataatccagccatatcgattgatgtcatatagtttccaattttcttaaatgccaactcaacacctttttcatggagtaatttagccacatcatttgcaaatacgtattgctccataagaggagtgcttcctaaaccattgatgagaaggccatagcgttctccagctttaagttggaaaccttcagataacttttcaaccaattctgaggccaattgtgctgagggttgcatcttctctttcttatatcccggttcaccgtggataccaactccgtattcaaattcatcatcttctagaacaaaacctggtttgccaacttctggaacagtagcgccagatagagctaagccaattgttttaatttctaagacaagtttgtcggccaagtccttcatttcagataatgttttaccagaacgagccgcatcacccaaaattttatggactaatatagtacctgcgacacctcgacgaccttgggtatagagactattttcaaccgcaatatcatcatcgactacaacacttgctacatcaataccttccatttcagcaagttcttgtgcaatttcaaaattcatgatgtccccagaatagttcttgatgaccatgaaaactccagcaccttcatcagccgccttgatggcttctaaaatttggtccggagtaggtgaagtgaagactgctccacaaatggcagcagacaacattccatctcctacaaatccagcatgacttggttcatgtcctgaacctccacctgaaatgagtccaacttttcctgtcttttctgcctttctaacgatgacatcaaaaccatctaagcgttctaccaagtcatcatgcatgaatgacaatccctgcaacatttcatcaacaacttgtgtcggttcatttataatttttttcatgagaaactcctttcggcatgtatctttgttttcgctttcattatatattttttattgctagatgataagggacagattctattatttgtccccttttaaacccgtttaaaacatttttttggtaaaatgaagtaagtaaaagaaaggcttcctatggcatcatcacttattacaaaaaaacggattaccaaggcatttagagaccttttagctactagagaatttgacaaaatctccattgtagatatcatggaatcagctggcattcgtagacagaccttttataatcactttcttgacaaatatgaactgctagactggatatttgaaaatgacttaaccgagtatatcaccaataacttggacttcattcagggccaaaaactattacaagaattatttttttatttcgaacaagagcgtgatttttatattcaactttttgatattcaagggcaaaataacttctatgaccactttatcagctactgtcgcttgcttgtatcaaaaattttaagagaatatggtcagattgatatcgattcatctgcttatacttgttttttgttagactatcattcacacgctctagcagaaatcgtgaaagcttacgtcaataaaaaaagtccagttccacaaccagactttctaatcatgacaattattggaaagagaccacaatgacatttatttcaaatcataaacaaaaaattatttcaagttacatttcggcaactgtcagcagtcatcctgaattagaaaaacaccctactttaccactagtctatcaaaaaaatcgcaatcctcatcaggttccaatattgtcgggtggaggttccggtcacgaacctgcgcatattggatatgtgggagaaggaatgcttactgctgctatctatggccaattatttactcctcctacaagaactgaaatcttagagtccattcgttttttaaacaatggtcacggtgtcttcatcattgtaaaaaatttcgaagcagacaccaaagaatttagctgggccattaacactgctagaaaagaaggaattaaggtcggctatagtctagcacacgacgatatttcaattgaacctcacaatagatttcaaattagaggaagagggcttgcagggacaatcttacttcataaaatcctaggatttgcagctcaaaatggtgccaacatcgagcaactaactgatttaggtcatcagcttgctcccgaaatcgcaacaattggctttgcaacgaaagctgctagtctcccccaagccacccttccactatttaacttggaagaaggaaatatttcctatggtattgggatacatggcgaagaaggctatcgtatcgtcccattccaatcatcggaaatccttgcaaatgaaattataagtaaattaagattgcactatcattggaaaaagggtgatcaatttatattgcttgtaaataatctaggcactaccagcaacttagaaatgggcatatttatcaatgatatccttcaactcttagaaattgaaggagtcactattacctttataaaatcaggaacatttatgaccagtctagatatggcaggtatatccgtaactctttgccccgtaaaaaataaacagtggttagaagcgctcaatgctccaacgacagcttttgcatggtaatttgcttgtataactcaaaagggctacatcacttgatggccctttgtttttatcttacgtttaaaagaactcattcttgacatttcaaataggccatctatcccttacaattcttccgatgagctttgagttttttcagagcccaatcatagtggcttgacgtactactgacaaagtaggaacctagacttgtccctcccgtccacttatagatacctttggtaaagagttcatcattgctaaaaacttctatcaactctaaaacctccctatgtgattgttctaggagtctagtcgcttcttctaaggaggttttctggtgcttcttccaaaaagcgatattcatttctccataagttttccaattataaggttcaggtagaaaaggcctttcgtgaccttcttgattagaatgtacccaagtcaaaagtaactgatgccattcataaagatggatcagaacatctcttagatttttatcccttttccagtgagcttcttttttctttgggtctcttgaaaaatcaaatggagtctgtagctcatcttcacttagttgggagatgaaacgattgagcttttcatagttttccttagaggccagtactagctcctcttttgttttcggtctaggcacagagttctcccttcatattgttagttattattagaaattttttatcctttaaatctctataacttatcctttaatttctcaacaaagagataggctgctggacaggtcaaagtattcttaatcgtcaaatggttgatttgatggatctttttgcgatctgtatgggggaactctcggcaggccttgggacgaacatcatagatggaacagagattatctcctcctagaaagggacaaggcatggatttaaaaaccttatcgccatctgcatctacctgaaggaactccgcttcaaaagctggtaatttcatcttaaaatacttggcgattcgtgtaatatccgcttctttaaagtccggtcccaatgtcttacaacagttggcacaggcagtgcaatcaatctcctcaaaaacttcttggtgtatctgctgggctatcttgtctaggtttttaggaggttttttctttagattggctaaaactttacggtgttccttctgcttttgcaaggctagctggtggtaatactcaatatcaatttctttagacatgatttctctcttattctatttgtttctcctattatatcatgcctcttcatcattgaaaagtggacttcacaagactatactattcccaaatgtatcaaaaaaccttgcaactaggttacaaggttaatgacattaatcgaagttaacgtattctttttgaagttcaaggacttcttccattgttgaacactctgtaagggcacggttagcgtactcttccatcttagcagtgtccaatttcttcatcaagctacgtgtacgaaggactgatgttgctgacatagagaactcatccaagcccattccgacaagaagtggaacagcttttttggtcaccagccatctcaccacacataccagcccatttaccttcagcgtgagctgccttgataacgttgttgatcaagcgaaggattgatgggttatatggttggtaaaggtatgaaacttgctcgttcatacggtctgctgccattgagtattggatcaagtcgtttgttccaattgacatgaagtctacttcttttgcaaattggtctgcaagcatcgctgctgcagggatttcaatcatgataccaacttggatatcatccgcaactgcaacaccttcagcaagaaggtttgccttttcttcttcataaactgctttggctgcacggaattctttcaaaagagcaaccattgggaacatgatacgcaattgaccatgaacagaagcacgaagaagagcacggatttgtgtacggaacattgcatctccagtttcagaaatagagatacgaagggcacggaatccaaggaatgggttcatttcatgtggcatatcgaagtaaggaagttccttatctccaccaatatccattgtacgaacaaccactggtttaccattcattccctcaagaacagccttgtatgcttcatactgctcatcttcagttgggaagtcttgagaatccatgtacaagaactctgtacggtaaagtccaaccgcttctgcaccgttgttgttaacaccttcaacgtcttttggagtaccgatgttagcagccaactcgaagtgtttaccgtcagcagtcactgtttgagcatctttcaaaagggcccattcagctttttgtttagcataagcttcaccagctgctttaaattctgccgcttgttcatctgttgggttgataatcacttcaccagtaattccgttaacggcaaggatatcaccgtctttcactacttcagtgatgttatttgttcccaatacagctgcaatttcaagtgtacgtgccatgatagctgagtggcttgtacgtccaccgatatttgttacaaaagcttttacaaagtttttgtccaattgagctgtatcagatggtgtcaagtcatgcgcaatcacaattacttcttcattgatagaagctgggtttggcaatttcttaccaagaaggtttgccaatacacgttttgtcacgtcgcggatatccgctgcacgttcttgcatatatgggttgtcttccatgccttcaaagatagtgatgaacatgtcagtcacttctttaagacctgcttctgcattgactttcttagcacggattgtttctttaatctgaccaatcaattctgggtcagcaagaaccatcaaatgagcgtcaaaaacttgagccgcttcttcaccaagcgtacctacagctttctcacggataagagaaagctcgttttgagaagcttcaagagctacatccaaacgagcctcttctgcgtttgtatcttcgactgaaacagtctcgaatgacaaatccggttgaacgagtagatatgcttttgcaactgcaacaccgtcagatgctgcgattcctttaagcatttctgtcattttccttatgccaatccttctttttccattgtttctgagattgcagcgatagcgtcatctgcatctgcaccttcagctgagatagttacatcagcaccttggccaacaccaagactcataacacccatgattgatttaaggttaactgatttacctttgtactcaagagtgatatctgaagcaaatttgcttgcagtttgtaccaacaatgttgctggacgtgcgtgaatacctgtttctgccactacgtggaaatctttagaagccatagtttgactctccttttgttctttcttttttgagttatatgtgataacccttacaatttggtattatatcatcttctaggatttttttcaagcattttatgggatttattcgatttcctttcagataacttgctgaaaatcttctattctagataacaaaacacaggatatagttttccaaaaaactacttctaggataattatcactatttcataaaacaaacactacatattgtgttttgcaacctttagtagaaaaatagaccactatatttagtttcaaatcattgacaaaaatttattttctgatatactaagaaagtaatctattttgaaagaggagttacacaatggtaaccgtttattctaaaaacaactgtgtccaatgtaagatgactaaacgtttcttggacagtaataatgtcgcttatcgtgaaatcaatcttgatgagcaacctgagtacatcgatcaagttaaagagctcggtttcagcgcagctcctgttatccaaacaccaactgaagtcttttcaggtttccaaccaggaaaactgaaacaattagcataatcttagtacatcatccagaagaaactgcttctagggctaacttagaagcctttcttttgtaattagataagggaaattttatgggattaaaacatcttgaagacgtgacttacttccgtctcaataacgaaatcaaccgtcctgtcaatggacaaatcatgcttcataaagataaggaagccttggatgccttctttaaagaaaatgtagttccaaacactatggtttttgattcaatcaaagataaaatcaactacctcattgaacacaactacatcgaaacagcctttatcaagaaataccgtccagagtttttggaagaattgtctcaatttatcaaagaccaaaacttccaattcaagtctttcatggcagcttataaattttacaatcaatatgctttgaaaactaacgacggtgaatattatcttgaaagcatggaagaccgcgtcttctttaacgccctttatttcgctgatgggaatgaagctattgccatcgatattgccaatgaaatcatccaccaacgctaccaaccagctactccttccttcttgaatgctggacgtgctcgtcgtggagaattagtatcatgtttcctgatccaagtaactgatgatatgaactctatcggacgttctatcaactcagctcttcaactttcacgtatcggtggtggtgtgggaattaccctcagcaaccttcgtgaagctggtgcacctatcaaaggctatgaaggagcagcttctggggtcgttccagttatgaaacttttcgaagatagcttctcttactcaaaccaattgggtcaacgtcaaggtgccggtgttgtctacctcaacgtcttccacccagatattatcgccttcctttcaactaagaaagaaaacgccgatgaaaaagttcgtgtaaagaccctttcacttggtgttgtagtacccgataaattctacgaattagcacgtaaaaatgaagaaatgtacctcttcagcccatactctgtagaacttgaatacggtgtgccatttaactacatcgacatcactgaaaaatacgatgaattggtcgcaaatccaaacatccgcaaaacaaaaatcaaagcgcgtgatttggaaactgaaatctctaaattgcaacaagagtctggttacccttatgtcgtcaacattgatacggctaaccgtgcaaatcctgttgatggtaagattatcatgagtaacttgtgttctgagattcttcaagttcaagaaccaagcttgatcaacgatgctcaagaattccttcaaatgggaacagatgtttcatgtaaccttggttcaaccaacgtggtcaacatgatgacctcacctgattttggtcgttctatccgtgctatggttcgtgcccttactttcgttacagatagttcgcacatcgtagctgttcctactatcgaccatggaaatagccaagcccacacctttggtctcggtgccatgggacttcacagctaccttgcccaacaattgattgaatatggatcgcctgagtctgttgaatttacaagcatctacttcatgctcatgaactactggaccttggtagaatcaaacaatatcgcgcgtgaacgtggtatcaccttccacaactttgaaaaatcagactatgctaacggaagctactttgacaaatatgtgactggcgagtttgttccaaaatcagaccgtgttaaagaactcttcaaagatgtctttatcccaagtgctgctgactgggctgaacttcgcgaacaggttcaagcagatggtctttaccaccaaaaccgccttgctgtagcgccaaatggttctatcagttacatcaacgacgtttctgcttctatccacccgattacgcaacgtatcgaagaacgtcaagaaaagaaaatcggtaaaatctactatcctgctgctggcttgtcaacagaaaccattccttactacacttctgcctacgacatggatatgcgtaaggtgattgatgtctatgctgctgcaactgagcacgtggaccaaggactatcactcaccctcttcatgcgtagtgacattccaaaaggtctttacgaatggaagaaagaaaacaaacaaacgacacgtgacttgtcaatccttcgtaactatgcctttaacaagggtatcaagtctatctactacgtccgtacctttacagatgatggtggagaagtcggtgccaaccaatgtgaaagctgtgtgatttaatctttccttgagaaaactactttttctcagataagtgattcattcaccctgctaaactagaataagcatctatactatgaaataacaaaaagtcgggcttccgactttttgtgcgatactcctctagaattatgataaaatagaagtaattgtgagttcgcaatactaaacacagaaagagatttcaaaatggaaacttactacaaagccattaactggaatgccatcgaagatgtcatcgacaaatcaacttgggaaaaactgacggagcaattctggcttgatacacgtattcctttgtcaaatgacttggatgactggagaaagctatcaaatgtagaaaaagacttggttggaaaagtctttggtggtttaacccttctcgacactatgcaatctgaaactggggttcaagcccttcgcgcagacatccgtacaccacatgaggaagctgttttcaataacatccaatttatggaatctgtccacgcaaaatcttactcatcaatcttttctaccttgaatactaaggctgagattgaagaaattttcgaatggaccaataccaatccttacctacaaaagaaggctgagattgtcaacgaaatctacctaaacggtagcccacttgaaaagaaagttgctagtgtcttccttgaaaccttcctcttctactcaggtttcttcactcccctctactatctcggtaacaacaaactggccaacgtcgctgaaatcattaaattgattattcgtgatgaatctgttcacggaacctacattggttataaattccaacttggtttcaatgaattacctgaagaagagcaagaaaaactcaaagaatggatgtacgatctgctatacactctctacgagaatgaagaaggttatacagagagcctctatgacggtgttggttggactgaagaagtcaaaaccttccttcgctacaatgctaacaaggcactcatgaacctgggacaagatccactcttcccagattcagctgatgatgtcaacccaatcgttatgaacggtatttcaacaggaacttctaaccacgacttcttctctcaagtcggaaatggttaccttcttggtgaagttgaagctatgcaagacgatgactacaactacggtttggactaattcaattatcccagaactgataacaaatatcatggcttgtttaaaacaaccatgatatttttgtttttgttttcttttgttttttaaattgattgattgaatactttatgataaaatagtaatagaaatagaggtgataacgatgttaaagcaagaaaaactagataatattctagaaacggtaaatacaaagggaactattactgtaaaagaaatcatgactcgcttggatgtgtcagatatgactgctagacgctacttgcaagagttggcagacaaggatctacttgttcgagtacacgggggagctgagaaaattcgcacaggttctattttaaataatgaacgttccaatattgaaaaacaaagcttacaaatcgcagaaaaacaagaaattagccgttttgcaggccatttaattgatgagggtgaaactatttttatcggccctggtacgaccttagaatcttttgcccgtgaacttccaattgataatattcgtgttgtaacaaacagtttaccagtctttctcatcttaaacgaacgaaaactaacagatttgattttaatcggtggaaactaccgctctatcactggagcctttgtgggaacactaaccttgcaaaacttagccaatcttcaattttctaaagctttcgttagctgtaatggtattcaggacaatgcgattgcgacctttagtgaagaggaaggtgaatctcaacgcatcgccctcaataattccaataaaaaatacttactagctgaccatagtaagttcaataaatttgatttctataccttctacaatatctctgatattgatatcatcgtttcagattctaaactgagcaaagaaacgtttgaacaactttcaaaacaaacaaaaattaattctttctaaaccataaaactgaggattgataaaaaataaaaatgcgtcatatcaagaaaataagaatcttgatatgacgcatttttggatgaagatttttacaaggagtttcctagattatttatgattgttgaaacggcataaaatctgaatcaaaggagatattatcccgttcttcaggactgataaaatttaaaaagatatttttaaattcttccagctcatagtctgaatggcaaatccattctttaccggtagagacataccatttcccaaaatttttcagctcctcattagtcaaacaaggtatttgaaaacatttatcaaaattgataatataaactttttcataaatagattggataaaatctttgaacatcttttgcctcactagaattctatatctaattactcattctactagtctataatctgactttctgctactttcttgtaccagtgagctgatttcttaggataacgttcttgagtttcaaagtctacatagaagagaccgtaacgtttttcataaccgtttgaccatgagaagacgtccatcaatgaccagatgaagtatcctttgacgtttgcaccatcagcaatcgcatcagataagacctctaagtgttgtttgacataatcaatacggccatcatcataaacagtattgtctacaaactcatctttataaccaagtccattttcagtgatgtaaatcttcttatagttcggataatctttcttcacgcgcatgatttggtcatacaaaccttgagggtagataatccaatcccaatccgtacgtggtacatagtcaggagctacacgacgaccaacacctttgatttggtatttagagcttcctttctcacccttaccattatggataatttcagtttctccatcaaaggcttccatccagtcactcatataatagttgatgcctagaaaatcattcaagtctttcgcagcttctaatgctgtgaaatcttcttcacgaagatccaagctaccaccattgactgataagatatggttgacgccttccatcgtttcagctgaatagtgacctagataagttgcatccaagataaatttattgtggatgatatcttccaactcagctgcacgaacatctgctggatttttaggatctaaaggatacttggttggcagtgcgtgaacaacaccaatttcacctttataacctttatctttatatagcttaactgcacgcgcatgagaaaccatcatattgtggtgcgattggaaaactttggcaaggtcgtactgaatacctggagggaattttccaaccaagtattgaccatcaccaattggcccaatttcattaaaggttgtccaatagtttacttctgggaattcttcaaaacagaaggcagcgtagtctacaaagtgttcaatattttcacggtttaagaagtctccatttgagtggagagcttctggcgtatcaaagtgatgaagagttacaaaaggctcaacatgacgtttgtgacactctgcaaatagattatgataaaattcaacacctttagcatttacttgaccgtaaccagtcgggaaaatacgtgaccaggcaatagaaattcgaataccattgacaccatactcttctgctagcttgaggtcaactgggtatcgattgtaaaaatcactggctggttcggcagtgtaccagtagttatcttcaagatacttatcccacgcaactggtcctttaccatcagtatgtgtagcaccttctgcttgataggcagctgttgcgccaccgaaaataaagtcttttggtaatgtttttgtcatttttttcacctatttcttgatttaaataaagtaaaagtgagaggagaggagtcagtgagccatccttctccatctcacttcttgtaccaagtcaccgaattgtaacatgaggaggtaaaaacgatagcttttaccgacgaattaataaggcgattaggaaattcgccatagcgattgccgtaacgataggagactgtttcacagtccctatcgttaatcgaattgagcttgtacgaatgcaagagcaccttttccatcacgtagttaatttgatgtattgagcgccttctgttttcgctagtttaataccgagcttatctgtttctgctttcatgtcttcaaagtttgaagcaacttgaggggcaaggataacaagatcaaactctggcaacatttcacggtgagcaccatagccacctgctgctgctttcacaggaacattgtattctgcagctgccttattcaaagcattcgcaagaagtccacttgtccctccacctgcacagagaacgaggacatttgtttcttcagtgattgtattttgtgctgcttctacaccagctttttcaagaatagcatctgcttttgcagtgttgaagtttgcggcaactttttctttcaattcatcattagatttacctgaacgctcttcttcaagaatttgttcatcatatactttaaggaatggatagtaaatgactacgtcaaccacgattagaagggcagcaagaatgaatgatagaacttggaagttcgtaccaagaactagacctagtggagctggagttgtccatggtagattagcagtaaatgagttcattccaagtgtttcaataaagaatttgaagatccaaacgtttgcgattggagcaaagataaatggaatgaagaagattgggtttaatacaagtggtgcaccaaacaagattggttcatttacaccaaagaatgttgggactactgaagcacgaccgattgcacggttacgtttagattttgttaaccacatgaacatgaatggaacaaccagtgtcgcaccagtaccacccatggtaacgataaacatttgtgtaccagaagtaagaatcttgtcagcgtgcataccttgttggagaaggttcaagttgacttcggcattggcataggtaatagctgcgatagctggttcaacgatagatggaccatggataccaacaaaccagaagaaagcaaaggcaccaaagataatcgtaatacctagataaccatcagcagcagagaataatggtgcaaagaatttaccgattgattcagctacgcttgcaccaacaaaatgacgagctagtaaatcaagagcataaagagaaacaactgatagagtgaatggaatcacatctttaaaaacttgtgagatattaggtggaacttcgtcaggcatacgaatagtgacgttgttcttaacacaaaccttatagatggctacagtaacaaaggcagcaaggaaggctgaaagcaaaccttttgtccccaagaatccagtagctaggccattttcgataggatcagctgccaacatcaacaaaccaacaatcgctgctaacagtgttgacatatagttgatttgattggttttctccatgctacggtttactgagtcagtcaatgacttagctgttgtaccagctaccaagagagccagaatacccatagaatagctataaggtttcatcagaaaggctacaacttcatcagaccatttaaagccccatgagtttggtacaaaggcaatcaagataaaaatacttgagaagagaataacaggcatacctgcaatgaaaccatcacgaatggcacgaaggtagatattacgagatagtttctcaaagaaaggctttcctttctcaataaatgcaattaatttattcattacttaactcctctcttgtagagttcaattaaatggtgcatcaaatcttttaataagatagttgtcatcaagtggtcttggccatgcatcatggttacactataggctaagtcctcacctgaagcttccttagccaatagacttgtttgcgcgtggtgagcctctgcaatgcaagaaccagcttcctcgactaagctatctgctttcgcaaaatcgccagcttcagcagctttcaaggcttccaatagttttgaacgagcatcgccagcataggctacgatttcaaaacctaacaatgttacttcttctctattcatgatagaattctccttaggtatttttaattaaatttttatgacaataaacgttggatatgtagaactagataaactcgttcacttttatacaaatcaagacccgtatgttgcgtaatcacatcatagatcttggaaccaatctcgaacgcttttggataggattgtttaatatgatcttccatatccagaagtgattggttatcatctctagatctgtctaaataatccaagaaataattcaaatgtatcataaaacgatcatagaaatgattattctctttggttcgttgaattgcatagtccgttaaaacttcttcaacattcctgagaatttctttcctcttatcaatcgactccacaagttccacttcattttcaccttcggcatttaatgaaatgataagcaatccgaataatttcgtcctcaggaaaatgatctgctagcttctgacgataaatttcaaaagcttcatttgcgatttgaaaagcgacaggatacttagtggaaatatctggtagattactatccttgtaccttccttgtgctagagcttggtaagaacagtaaatatgatctgtcaaggttacgtagagatactcttgaattggataatgatatttctttgatagcttatcaatgatttcataggtcactgtgataaaatcaagcggaacatctttgaggagagccataaagttttctcttgactcttctgtcttcatccgaaagattttctcaatatgctgttcagtaatcaaatctcccttcctctttccaaatgtaatccccttaccaatcacaatcacttcttctcctttatcatttctgacaagcgagacattgtgattcattggatttagaattcgatacatgtcaacctccttttatatcttaaaggtatatgagtacaaaaaatgaccacaaatgaactagaaaatcagccgatttctaattcacctgtgatcatgcctaatattacttagtaacactcaccttgtattaacttgtgatttaagtatagcacaagtaagttattttgtaaacctttacataaaactttttttaaaatttttttagattcatgttcctaacctaggaggacttgcttacacgcgttctttccatgaagtcgctgttgtttgaagaactttattgagctcatcaatgttttcaaaaccagttgtgcgaagccattcgcgagctgctgcttcaccatctttgatgtatgcttcaactgatccagcccatgtagcacggccacaaagaactccgttaaagtttgcacctgattcatgagcaaatacaagagtatcttggaaaagtttagctgatacaccagcactcaagtagatgtaaggcaagttagttgcttcatcttgagctttgaagaaggctgctgcttcttcacgtgtataaactacttcaccttcagcgaagccttcaacatatttaatgttaacaggaacttctactttcaagacatcaatgttaaagcgtgggtctgagaagactttcatagcaccgataactttgtgtggttttactttcgcgtattctacagaaccagcgtctgcaattttttcatcataagcaaggatttcaaggaagaatgggatatcttcagccacacattcagaaccgatacgttcgatgtaagcttgtttttcttggttaagttcgtctgagctatctacatcatagtaaagcaagaatttaactgcatctgcaccttcttctttaatacgttttgcagaccaaacatccaagcagtctggcaaacgttttgtgcttgttgtatcataacctgttttttcataagcaaggagaagaccagcttttggatcaagagcttttgtagctggaagtccatattcagggtcaagaagcattgatgaagcgtatttagtcaattcatctgctaccaagactttaagttcttccatttgagccactgttggttcttctgtttggtgttgagccattaggcgtttcaaagcaccacgttggtcaaatgcaagagctgagatgattccattttcatcagaaagtttttctaagcgtgcacgtttttgttctgttaaagccattttatacctcttttactattaattgatcatatagagcttgatagttggccatgttgacatgaccagtcattttttcttgagcattgagcataccaaggacatttgccttgatgagtaattctgcatccgattctttatgaagtaaacctgaagaaattccagcaactgtagaatctccagatccaacagggttgactacctgaattctaggaatatctaccttgtagaaagtgtcaccatgtttggcaaaggcaccgttggcaccaagcgaaacaataatccattcaatccctgcaaacaaaggttcttgaaggacttcttttaattcatgcaaatcctcagaaacttctcttccaagaagctgagataattcctcattatttggtttgatgactgttggtttatgtggtgattcaagaaccgcctgaagtgctacaccagagcagtccaagacaacgggcttgccagcttgattagcaagttctaccaagctcgcatagtaatcaactggaaggccagctggcagactacctgagatagctactacttcaactgacttcaagagttttttgaaatgttccaaaaagtcttgaccttcttgttcaagaacttcaggtcctttttcaagaacttctgtttggttgtcaccgtggagaatagcaatacagttacgagtttctccctgaattgagaagaaatctttctttacttgatcatcgatattttcaaccaaaaactcaccaagtttgccacccactaaaccagtagcaagaacagaatccccaaattctgaaagtactcgggtaacattgagtcccttaccaccagccgttttggttacatccaccacacgattgacagtatcaatcttcaactcatccaaaggataggaaatatcgatggatgggttcattgtgactgttaaaatcataggtcacctcttagtcgtggtattctccgcgatcccatttttcaaggaattcagtgaagaagtttgcgtctgtttgttgagcattgtgactttcaaggtgttcaattttcgcaatcaattttttgttttcttcagatggtttgtattcagcatggatgaaagcttcgatgatatcacacatgagcaattcaccagtaatcttaccaccaaaaccgataacgttagcgttcaattgctctttagcataaagagctgttgtcatatcacgaaccaaggcagaacggacacctggaactttatttacagcattgttgataccaacaccagtaccacagatacataccccaagatcagcttgaccgctagttacagcttcccctacttttttaccaaagattgggtagtgagtacgtgtatggtcatatgtaccaaagtcaatgacttcatatccttttgatttcaaaaattctgaaaccgccattttttcatctgttacgatgtggtcacatccaattgcaattctcattagttattccctccgattaattatataaatctaatatcatttatccttactcaagaaaaatcaagattagcttaggaagcgagctgcgagcataactgaggttagctaaagtgagctgacgacagattatcttgatttttgaagcgtattagcacattttgttcaacatatcgaccctgatttggtgacgtccaccatcgtatttaccgttaacaaatcctttagcgatgtttttagccaattcatcaccaacaagttgtgcacccatagtgatcatacgtgagttgttgtgaccacgagtcatataagctgaacgttcgtcagatacttctgcagcaaccattcctttgatcttagttgcgaccataaatggaccagctccataagcatcaatcacgataccaaggttttgttcttctttgtttacttctgcagcaacagcaagagtcacatcaacaaagtcttgaccttcagctgtaacatccacaacgtggaagttttctttttccaagaagtctttcacaacttctttcaatctcaaacctgcagcatctgcaccgataacaatagacatattgtatactccttttatttttctaggctagtaaaaacttttatggttagcagtttacctacaaaaagttttctagcagtttattgacaaattggattgaatgagatgaatgacaccttattcaagtttaggaaatcagtttcctagaaataatctttctctacgaaagagaatataacaagtgattgtttgtttgtgacaaacatcatttgttgcttacaaacataatatactcctatttacttaaaaaagtcaacaattaatgtttgtttttgtgtttttttaattaaaaaatttcgatatcaaaaccaatttgatccacttgaccaggttctaggagacgaacattcttcttatcttctagatgatctccttcttcaagggatgttgacaagccagaccagggttcaaaagcaatgaaaggacctttattcaaagttgaccagataatgagatttggaaactctgcaaagttcactttcaatcccttatcatgtttacgagaacgaagggcaattgttctagattgcaattcatctaaggtgactgcatcagtgctgaaaagatcatagctgaggtctaattctttttgaccttctagccatggacttctatcttgaaaatcaagcatacctgtttctgggaaaggacgtggaacagagcaagtctcttctttttcaaactctagataataatcttcatagacttcatcatcaagcagaggacaattaaatcctggatgtccaccaataaagtaaggcatgaccttgctaatttctttattaaatattttgtattgagtccgcactgtctttccagtaaggatataagtgatttctaagcggaaatgataagggtagttctgatagctattctcatcgtcttcaattgcaaaagttacactattatctgtctgttcaactaattcaaattctttcttacgaaccaaaccatgacgaggaatctttcctttgatttcttgtccattatcatctatataaagtgctgtatcctctctcaatgaaccacaaatggggaagagaacaggagcttgtccactccaataagtagcatctccttgccacaaatactcaactccctcggcatcttttatagaagaaagagccccaccaaaactgttaaattcaactcttaattgttctgattttaattcaattaccatgattttctccgatttcttgatagtttataaaaaactaggttgtcactcctaatggtatgacaacctagtttcaacaatttacattttataggagcgcattattttgcttttgctgcgtactcttcgttacgtttaatcatttgttttctgtaccatgcaaagataccgatatagaatacaaggaagactactgcaccaaggattgctttgatatcaccagttgtagtgttaccaattgaccaaccaagaagtttttcgattggtccttcaagagttgagtgagtgatcaattgagtttggctcacaccttctgggaaggcacctacacctttagcaagttctgttgcaaatggtgcgataagcgtacctgaaagaaggaagagtggcaacaagagtgttccgaagataatcatacggagcaatttaccacgtgttacaaccaagagagctggagtaacacccatagcgataatacctgcaagtggcaagataccatttccgacgtttgaaagaagcactgcttcaaccaacatgattggtgcaagtacgttggcacaagcccagatttcagcacgaccagcgatgaatggccagtcaagaccgatgttgaatttacgtccttgaagacgtttagtagcaacgtttgtaataccttgtgaaagtggttctacggcggcgatgaaccaagaaccgattagtgagaagagttccaaagatacaccggctgtcaaaccaagagacaaccaacctttgataacaagttcccatttatcagcgccttcaacacctgcaactggatgtggagtacccatcaaaccgataacgataccaaggatgaaaccgatgaagaatttagaaccccagaaaccgattttcttgttcaatttagcagcgtcaaagtcgtatttatcaagacctgggaaaagtttttcaaaaatcttatccaaaaccatgataactgggttcatcatgtagttcatgtgagttgaagtcattggtgatgaacttggtgcattaagaaggtcatcaaatgtaggtttcatcaagtcagagttgatgattttaagaaccccaacaagaacaactgctgcagtcgcgataaagagtgaaactccttggctaacgccattgttgtctgcataccatttaatcaaaagacctgtgatagacaagtgccagatatcgaagatatcaacgtcaagtgtatcagttttcttcatagcaagcatcactacgttgacaatcaacatgatgagcaagaagtaaagtgtccaagcagagccccaagtgattgtagcgagtggtgcccaaccaacgtcggtgatgttcaattgaataccagtattctcaacgaattttgcaagtgatgctgagaaagcaccatttagcataccgatgatggcaccgataccagtaagagcgatggcaagtttgataccaccttcaagcgctttggagaatttcactccaaaaagtagagccaatactgtcaaaatgatcagcatgatgattggcccacccatatccaagataggtttgaacagcttattggctagttcgataatgacatccataatagttcctccctttttatagttatatgaatgttaacaaattaaaattagcttaacccgtgttctttgatagctgcttcaatattatcaaatactggagcactcattgctgggatacggaataagattggtccagcttcgataactggaatacctgggtcaaaaccaagatctgttgcagcaattggtgtaaaaatgtcataacctttgataaggtcttcattaacgtcttttaccataactgcatcacagtgaacatcaaaaccgcggtttgaaagttcttcttcaagagcacttttaatttggtggcttgagttaacacctgcaccgcaggcagcaagaattttaatcatatggatttcctccgatttaatatttttaatagacaaaattaagcaattgcttcagcaatataagcatagagggcttctggttcagaaatttttgataggtcttcaagatgactatttccagtaaagaagtccatcaactgagcaagaatgttcgtttgacttgaacttgagttattaatgataaagaagagcaaggatacttctacttccttatctggcgcaatcatattgtggaaagtcactggtttttctaatcgaacgaccacaactttttcggctagattatgaacaatatctgtgtgaggaatagccacattcggcaaatccttacccaaaaattccatatctaggccagttggaaatgacttttcacgcgtgatcaaggcttcacgataagttggagttacgatttctcgttcttccaataaagtagcaacctgatcaaagagatgttcttgattatccgcttctaagcaaaacacaaggtttttgtcaaagaaatgatctaatcccataaggttttcccttctttccattaactttatgctataagtataacactatatgaaatcgttgtcaataattttttgttgttttttgtccttttttcaattattttgtttatttttatatttacaaccaaaaacaaacatttaaaacaaacactttaaacgatttaatcctattataaatgcaaaaaaacaggcctatttaagcctgttttactattgattcttatgtaagtttcctgtgaacaagaaaaacaattatgataacttattcttcatccatgctcaagacgctaaggaaggcttcttgtggaacttctactgatccgatagctttcatgcgtttcttaccagctttttgtttttcaagcagtttacgcttacgagaaacgtcaccaccataacatttagcaagtacgttcttacgaagggccttgatatcagtacgagcgacaatcttctgtccaatagctgcttgaattggcacctcaaattgttggcgagggatgattttcttaagcttatcaacgatgagttttccgcgttcgtaggcaaagtccttgtgaacgataaagctaagggcatccaccttgtctccattgagaaggatgtccattttgaccagcttagaggggcgatactctgacaattcgtagtcaaagcttgcataaccacgtgttgaagacttaagcttatcaaagaaatcaaagacgatttcagccagtggaatttgatagataacattgacacggttatcatcaatatagtccatagtcacaaagtcaccacgcttgcgctgagctagctccattacagctcctacgaactcctgtggtaccatgatttgcgccttaacataaggctcttcaatggtcgcaatcttggtaggatctgggaactcagatgggttagacacatccatagactcaccgtcggtcaaattaactttgtaaataacagacggagctgtcatgatgaggtcgatattaaactcacgttccaaacgttcttggataacatccatatggagaagtccaaggaaaccacaacggaaaccaaatccaagtgcctgagatgtttctggttcaaactgaagactagcatcattcagttgtaatttttcaagggcttcacgcaggtcattgtacttgtttgactcgataggatagagacccgcaaagaccataggattcatctgtttgtaaccatgtaatggctctgccgcaggattggttgccaaggtaacggtatcacccacacgagtgtcttgaaccgtcttgatagaagccgcaatataaccaacgtcaccagtcgcaaggaaatcacgaccaactgctttgggagtaaaaataccaacttctgtcacatcaaaggtcttaccattgctcataagctgaatcttatcaccaggtttgacaaccccatccatgacacgaacttggaggataaccccacggtaagcatcgtaaacagaatcgaaaatcaaggccttaagtggtgccgtcacatcacctgttggtgctggtactttttctacgatttgctcgaggatttcttcaatcccaataccagccttggcagaagccaaaactgcttcactggcatccaaaccaatgacatcttcaatctctgtacgcacgcgctcaggatctgcagcaggtaggtcaattttgttaatgactggcatgatttccaaatcattgtccaaggctagataaacgttggcaagggtttgagcctcaataccttgagcggcatcgaccaccaaaatagcaccctcacaggcagcgagcgaacgtgaaacttcataagtgaagtctacgtgccccggcgtgtcaatcaagtggaaaatataagtttcgccatcttttgcagtataattcagctcaatggcatttaacttaatggtaatcccacgttctcgctctagatccatgctgtccaaaagttgagcttgcatttcacggcttgaaaccgtctctgttttttccaaaatgcggtctgctagagtcgactttccgtggtcaatatgggcgataatagagaagttacggatcttctcctgtcgttttttcaattcttctaagttcatgattctcttcctttcagggtatctatttattataaattgtttttgacattttgacaagaccataccctgctaggagtactaatcttcagcaacaaagccctcattttcgataaagtggtgttctgtcattccttggtctgtaaagacaatcccatgaaggacaccaccatagacagctcctccgtccattccaatcttgccatcttctgtagtccaaagctcagcagtaccacgctcttgctttaacaaaccatagactggtgtgtgaccaaagacaatgcttttcccagtatgattttctgcttcgtggaatggttttctgagccagacttttttataatctgtggtttcatgccagtcgtctaaggtcaaatcaatacctgcgtgcacaaaaatatacttgtctgtctctaccacaaaaggcatttgacgaatgaattcgaccaagtctgctgcttcggtagcaactcgcttggcatcctcaactccatcaactggtgcatccaagggacgacctaggatagagttaatggttgtatctccaccattacggcgatagtgatcatagctttcttctggatcatcgagccatgtcaaaaacatatactcgtggtttcctgataaacagatagccccttgattgtccactaagtccttaaccatcactagaacacggcgactatcttcaccacggtcaatcaaatcccctagaaagagcaactgggtctgaccatcccatgttttgagaaggtcttccagcatcccagcttttccgtgaacatctccaattacataatagtctgtcatcttatttctccctgtttctcaacaattctctggcttgcgtcagggctgcttccgtcacatcatcacctgccaacatcttggcaacttcctccactcgctcttcaaccgtcaaaagacgaacagtcgaaaccgttgaatgctcattactaatcttctcaataaagaattgataatctgcaatcgcaatcacttgtggcaagtgggagatagctagaacctgaccatgttggccaatcttgtgaatcttctgtgcgatggcttgagctacacgacctgaaactcctgtatccacctcatcaaagacaatgctggtcttgccttctttacgagaaaaggcagacttaatagctagcatgagacgagataattccccaccagatgcaaccttaaccaagggtttaaagtcttcgccagggttggttgaaatgtaaaactcgaccatttcattgccctcacgactgaatttgcccttgctaaaacgaacctgaaactgggctttttccatataaagatcttgaagctcttgtttaatctctgcttctagctgctgagctaagtcatgacgagcagatgcaagctggcctgccaagtcgacaagattaacttccaatttcttgagttcggtttccatatcctcagatgaaaggttatttcctgtcaagagattgtattcttccgtaatcttggcgaaataaagcaagacatcgtctacagtcccaccatatttacgcgtaatggtatgaaggaggtccaaacgattctcaacctgcataagacgattgccgtcaaaatcaaggtcctcaatgatagcttccagacgtttgctaatatcttctaagacatagtaggtctcagacaaagagcttgaaatttcacggtattcagggtcatactcttcgacactttccatgtcattcatggctgaacgaacattggccagacttgaaaaatcttcattgtccaacatactgtaggcattggtcagcgtatccgcaatatttttatgattgagaagtttatcacgctcctgattgagagccagatcttctccggcttgcaagtttgctgcctcaatctctgccatttgaaattccaacatttcaatacgagccttgtgttcctgttggtttttcttgacttccaaaacctgcttacgcatttttcgataggcatcaaaactcgtttgataggtttcttttaggtcccaaaaagctacgtcaccgaattcatccaacatctggatatgcagttgagggcgcattaactcttcttggtcatgctgaccatgaatatctaccagatgttgcccaatagcacgcaaaacagacagattaaccatctggccattgacacgactaatactacgaccattttgcaagatttctcgacggatgataatttcatcacccatttccaaaccttgctcatcaaaaatttcctgtaaaaggcgactattctcaactgagaaaagcccctcaatctctgcctttggcgcaccatgacgaataacatctgtcgtcgcacgagcccccaacatcatattcatagcatcaatgataatcgacttccctgcacccgtttcaccagtcaggacagtcatccccttttcaaaattgagggaaatagcctcaataatggcaaagttttttatcgaaatttcaagtaacatatagacctaccaattttttacttgttcaaagatttcccctgctagactttcacttctggcaatgactaaaatcgagctatcatcagctaaacagctaaaaattttgtccgcaaaagtctcgattaactgagctttcacaaaggctgtatttcctgggatgacttggagattgatcatcttgtccatcaattctgccgattcgatattgtcttcagccagttgcaaactttttacgattgattttggcaattcatagacataagtgttgtctctcaaaggaattttgacaatacctagttctttgatatctcgtgataccgtcgcttgagtggcagtgatgcctgcttctttcaaatgttctacgatttcttcttgtgtaccgatttgataatctgtcacaaatcgtctaattttttcaagtctctcttttttattcatttttaaattgactatgcgccctctctactatttcttcaatttcagcaagaacctgattacttgctgactcttcttttttcaaatacgctaaaaattcaatatttccatgcccaccttggatgggagaaaagtccaaaccaaggactgaaaaaccttcctctactgccatagctgttacagattcaaggactttctgatggaccttggcatcgcgaataattccatttttcccaatctgctcacgtcctgcttcaaactgaggcttaactagagccacaacctgaccttgagctgccaagactcgatgcaaggccggaaggatcagactgagagaaatgaaactcacatcaatactggcaaagctcggttccttttcgaaatcagtcttttcagcatagcggaaattaaactgctccatgctgacaacccgcgggtcttggcgtaatttccaagccaactgattggtgccgacatcgactgcaaagactaactcagcaccattctgtaacatgacgtcggtaaaacctccagtagaggccccgatatcaatcgttgttgccccttccactgacaattcaaagacctgcaatgccttttccagtttcaagccaccacgactgacatacttgagtttctcgcccttgagttttagctcggtgtcatctggaattttctctcctggcttgtcaaaccgttctccattaaggactgctacgactagaccagccattactccacgcttggcctgttctcgcgtttcaaacaagccctgtttataagctagtacatccactctttccttagccattgattctcaaactttctactacttttacaatcgattctgtttcaaagggaacctgctgagcaatttcttctaatttggcattagcttgatccagagtttggttacaaaaggcaatagcctctttcaagcccaacaaggctggataggttgacttttctgcctgcagatccttttgaggtgtcttgccgatttcctcaaaactagctgtcacatccagtacatcgtctcgaacttgaaaagcaagcccaatcaattcaccaacagttttcagctttgcctgcatttcaggtgacaattcggctataatagcagctgcttggaagggataggctagtaacttcccagtcttattagcatgaatggtctgaagttcttccaaagacaagtgctggtgttcaccctccatgtccaaaacttgccctgccaccattcccagactacctgaagcaagcgataagttggcaatcaagtccaccttgatctgacttggcaaatctgcctgcgctatcaaagcatacggatctaggaacaaggcatcaccagccaaaatcgccatagcttcaccgaatttcttgtgattggtcaatcgtccccgacggtaatcatcatcatccatagcaggaagatcatcatgaatcaagctccctgtatggatcatttccaaagcagcagccacctgcgcgtgagcaggtttgatagcaacctgcaaggcttccagaacttctaacaagagaaaaggccgaatacgcttgccaccagcatgaatggaatagagaacagactctcgcaaactagaggcaaactgctggtctccataaaagtcttccaaggccgactcgacaagagctaatttttcttgctttttcattcaaaatcactttctgttccatcttcttgcatgaccttaactaaggtcttttcagccttgtccagcgtcgcttggagttcttttgacaagaccatacccttttgaaaggcagcaatcgcatcttccagagcaatttcaccattttccaaactttgaacaatggtctccagttctgctagattttcctcaaatttcttttgttttgacatctttaacctctaattctactcgaccatctcgcatcaaaagcgtcacttggtcttttttcttcaaactctcaaccgaatctacaacggactcttcttttttgacaatagcataaccacgcgccacaattcgactggtatccaacatcaacaaggcttctgaaagtcgcttcacttcagcaaccttggcatcataaaccagagccatttggctacggaggagcttatccaactggcctaaacggtcttgatagcgttggattttggtaacaggtgataattgtaccagtcgatgtatccttgcttggacgacttgtttgttatcagaaatccgtgttcgcaaactttgtttcaaacgcaattgcagttgatccaagcgttgcaaatagccatcatacaagcgctctggctgtctaaagataacagaatgactgcattttttcaaagcttcttgtttcttcgataggacatttcggactgctgttgccattcgtttttcctgattttgcaaatgagctaatagatccaacttggtcacaggtgttgctagttcagctgcagctgttggcgtcgcagctcgtctatctgccacaaaatccgccaaggtcacatctgtctcatgtcccacactagagataactggcaaacgagactcaaaaatagctcgtaccacaatttcttcgttaaaggcccagagatcctcgatggaaccaccaccacgaccaataatgagcaaatccaaattgtcccgttgattagcacgcgcaatatttctagcaatttcctccgcagaaccctcaccttgaaccttagtcggatagaggaggatatcgacacctggaaatcgcctgctaacggtcgtgataatatctcgaataacggctccactgcgactggttactacaccaattctcttagaaaattggggcagaggttgcttgaacctctcttgaaacaggccttcttctgccaattttttcttgagttgttcaaacttaatcgcaagcgccccaaccccatcaggctctgccttttcaatgataatggagtagcttccacttggctcatagacctgcacacgcccaatcacattgatcttcatcccttcttccaggtcgaaacctaatttctgataaattccagaccagatggtcgcttgaataactgcatggtcatcttttagggagaaatattggtgagtaggtcgtttacgaaaattggaaacttgaccagttaaatagacccgttccaagtaagggtctttatcgaatttcattttcagatacttggtcaaagttgttaccgataaatacttttccatctccacctactattcattttcttgctctttcatgggtattattataccaaaaatatgcctaaaaatctccatttatgtaccattatgagggaaaaataaaaaaggaggcaaagcctccacatctgattatttgctgtttcgagcttcttccaaaatcttttcaatcttggttgtcaacaggtcaatagccacggtattgctgaccccttcaggaatgacgatatcagcataacgcttggttggttcgataaactgatgatacataggtttaaccacacctaagtactggtcaatgacgctatcaaggctacggccacgctcttccatatcacgcttgatccgacgaataatgcgcacatcatcatctgtatccacaaaaatcttaatatccatcaaatcgcgcaggcgcttatcctccaagaccaaaatcccctcaacgataaagacatcttgaggttcttgacgataggtcttgctacttcgtgtatgctctgtatagtcgtaagtcggaatgtccaccggacgccctgccaacaattccttaatctgctcgatcatcaagtctgtatcaaaggcaaaaggatggtcgtagttggttttgacacgctcttcaaaggtcaaatgagactgatccttgtagtatgaatcatgctcaatcatggaaatcttttcatcaggaaaatgcgataaaatggctcttgaaacactggtcttaccaccaccagaaccacctgtcactccgataatgattggtctattttgcatgctatcctccgtttttttatccgtcgtctattctatcataatttttgcaaaatttatagtctggtttgaatagtctaggggaaacaacactccctacaccccagttagatcagctaaaaaccttccttggcttgtataaattgtctcgcttttctagaatagctagtaatttatcatcttcaaaggcagctaattcttgttctgtttgttcgagttcgataaaacgaccaaagcgcacttctgcagcctcttcttgagttaggaaaactttgacaaggtcgcctgtcccaatctctagaggatgaagaaagtccaattgaccagcctccactttttcagcaatttcttccaaggtaagagcatcttctagttgcaaaccagctgcactagtacgtgttaagtgagacatatgggccgcataacccaatttttctcccaaatcaacagacaaggtacggatgtaagtccccttgctgcatttcacacgaaaagtaaaacgtgctagattcccctcataagaaatcggacttgtccgctcaaattgataaatggtcacctgacgttctggacgctccacttcttggccagcacgcgcatactcataaagcttgcgaccattgacctttacagccgaatacataggtggaatctgggtaataggcccagtcagactggcgattgcttcatcaacaagcttttcatccaagggcgataaaacaggtgtctctgcgaccacttccccactagcatcctctgtcgtcgtggaatagcccagagtgattttcccctcatagaccttgccctcatcctgcataaactcgaccatgcgtgttgccttgccaaccgcaatgggcaaaacacccaccacatccggatccaaggttccaccatgaccaatcttcttggttcccaaaatcttacgcagtttaaaaaccgcatcatgcgaggtcatgcccgcttctttttttaagttgataataccgttcatttttgctttctaattcccttttcactttacatcaacatattctatcttagacagattttaaaactatatcagcttatttttctaaatacttcctagcttcctgaacataaaagagctctggattttcatggacgatactttcaaacaaactacgggcacgagcttcatctccttttaattgggcattgagagcgccgtaataagaaaacatgattcgagctagcttactttctggctcagtaatgttaaagtagtcgttcacttctttattgaacacaatatcttttatggcttgggcttgagcaacaagtgtagctttgcctcctttaaaatctggcgccttggacaattgttcctcaaagaaagcaatatcttgcacatcttggagatgaatggaaactgttaatagttcaaagcttgatattaaaaacgcaggggttctgaatctcttccaaatttttttcaaatcatatttggacatattttccttggcagcttgaaaatctccttttaaataagccactcgaccttggataatttggtaattctcacgatatgttgccctaaagggcttaatagatttttctgattgaactcttaacatgtcttcatatagcttaagatcaatagaatcgtgtaacactagaacaataacttttctagatacaaatcttaaataaaatacaaagacgagaactaaaaagtcaataactaataatatgagtcccaatatttccaaattgctttgaaatattaaaaatactgccatcacataaatatccaagactaaaaataagcaaattagaataaccctatcaagttgtaaaagagtgttttctgtcgccctacttactattttttttactaatttcatatattactctcatttcactgattctaaatattttttcgcttcctgaacataaaagagttctggattttcatgggcaatgctttcaaacaaacttcgggcacgagcctcatctccttttagctgagcattgagagctccgtaataagagaacatgattcgagctaatttattttctggttcggtggtgtcgaagtagcctgtaacttctccattgagtatttttgatactggttcaattaaatccaacattctatttttatcaattcttttaattttttcccaatcataagaaactaaaagtttagaaatttcatccgtctcccttaaatgaaggtatgataatgattctataaatacgatgtttagttcataaatacgtttcaaattcaatttagaacttttaactcttattcgttcagcatattggattgcctcactaaaattcccttgatagaaagcacacctagctaaacccagatttaaggcatttaaattccctgttttattatcaggccgcctttcataagtttcagttaaaagagaaatatattttataaaattcacttgctcgtataaaataacttctgcaacgtgatttactaaaaaatgagttattacaacgataatagtcagtaatgttagaaatatgagcaataatgtagtaacgacggttgattttacgaataataaactaattgctgttgctataattatccaacgtagataaaataaaataaaaacctccagtatgctgcagattcgaactgatgaccaattcgagatattcttagaaatattatctaacataaaaaactcctataaaaaattacaaactaatttatataaacaaactagctaaatgagctagcaaagtagctccagcttttaagaaaaattaattcaattttatcagctgaccatgttctaataatttctatagttcttttcatataacactcctgtttttaagataatctcactcccccttcagtgcttcaaacttcgctttcatggttggatttttacgtgtcaatttcttgacagagacatcttccagcttattattagccagacggagttggttttcagatgttgttaggaactttttaacctcttccatccgttttatggccttgtcgatttcatcgattgccttaccaaagttggtagaagctgaattatagttcttagcaaatgcctgtttaaaggcatccaaatcttcctcaaaatgcgtaatgtctatattttgctcgcgaactaaggccaactcctgcttgtattttaaggaattaagagcagcattacgcaagagtccaatcaactggataaagaattgaggacgaaccacatacatcttttcatactcgtggctgacgtcaacaatccccgtgttaaagtagtcattatcggcctcaagcatagtcaccaaaaccgcatattcacagttcttctcccgacggtccttgtccaattccttgtaaaaatctgcattcttgtgcttcttctctgttccgtcagcttcatttttcatctcaaacatgatggaaatgatttcaacaccattttcatcactctcgcggaagataaagtcgcctttggaaccacgcgcagagaccttattatccttctcaaagtaagcatttggaaaggcaaaactgcggaccttgttaaactcactctccgcatagtgttccaaactttccccgatagcttttgtagattgttgagctttgaaattcttataaaattcgacttgttcactggctgccttgagctgggcttcgtagttttgcttaacagaagccaaagataactcattttccttttcttgcaaaagtagctgatttttaacctgatctcgttctttttctaggtcagaaagggtcttttgcagttgattttcatgttccaaacgcaaggtggccaattggttttccaaggcctgtacttccttatccttagccaataaggcctgattgcttgtctgttcaacctctttcttggccaattctttttctgtatcaaagttttggatttgactctgtaattgcgcaatttcttggtctttttgagctagtttagactgttgctcattcatggccttttgctcagccaaggccagttcctgcttcatgcgatcgtgtagttccttatcaaactctgctgttctcacttgggacaaaagttcaacatactgactttcatttactgtaaagacttccccacagttggggcatttgatttcgttcatatcgttcctctttctagacttctgtaaccattatatcatgcctgaaggaaaatcaaaaacagtgagtcgaaacccactgtttatctttttttactttaaattttttccaaggccaagcgcaaatcttcgatcaaatcatctacattttcaagtccaacagacaagcggatttggtttggtgtgacacctgctgcttctaggtctttttctgacaattgaccgtgagtggttgttgctggatggacaacaagagatttagcatctgctacgtttgcaaggtcagagaagatttccaaactatcaattaccttgcgagcttctgcctccccacctttgacatggaaggtaaagattgagcccacacctttaggcaagtatttctcagccaaggcatggtaaggactatctgcaagttttggataattgactttttctaccttaggatggttgacaaggaaatcaacaattttctctgcattttgcacatgacgttcgacacgaagagaaagtgtttccagtccttgaagcaagaggaaggcattaaatggtgacaaggctgcacctgtatcacgaagcaattggacacggacagcgataataaaggctgctgcacccacatcacgagtatagctcaagttgtgatagcttggatcctcgtcaacaaattgagggaatttccctgaagccgcccagtcaaaacgaccactatcaacgatcactccaccaatagtcgtaccatggccaccgataaacttagtcgcagagtgaatggcaatatctacaccgtgagaaaagacattaatcaagtaaggtgtggcaaaggtattatccgaaacaagtggaatttggtacttatgagcaatctcagccaatttttccaagtcaggaatgtttatcaagggattccccaaggtttcaatcaaaactagcttggtattgtctttgatcgctgcttctacttcctccaaattatcaacatcgacaaaggttgttgtgatcccataacgaggaagggtttctttcaagagattgaaagttccaccgtaaatagttgaggctgctactacatggtcaccagcgtgggcaagtgccaaaatcgtataagtcactgcggccatacctgatgctgttgcaagagctccaacaccaccttcaagagcagcaattctttcttcaaaagcagctgttgtagggttggtgatacgagtataaatgttccctggttttctcaaggcaaaaagatctgcaccttcctgcgtgtcatcaaaaacaaaagatgttgtttgataaatcggcactgcacgagacttggtagctggatccacaacttgaccagcatgcagttgcaaagtttcaaatttaaaatcacgagtcataaggcgacctccaaatagtttgattaaagatattgtagcaccttaaggtatagtttacaaatattagttttctatattttgatatagtaaataactattaccttattttaaaaatgaaaaaagcacgactcaatcgtgctcattttcttaatctacataagtatcttcatttttattgaggaaggcatatggaagacccatcaagaggcctcctccgataaagtttccgatgaaggttacaccccagtggcgaagcatatttccaataccgaagttggcaattgagtcagcagcaacactgaattttacaatcgcgaaagaagcaaagttcgcagcaatgtgctcgtttgttaagaatacaaacatgtaaatcgctgataaaacgagccatagtttagcaccaccatctttgaccaaaacaaatgaaagaatcgcaatatttacgaaaatatttgccaaaatcgcctcaagcaagattaattcatttgaacggcctaacttcatctcaacaacccctgagatgaaactatcgtgagtcagatttgcataggctgccgaatgagcaaagccccaacctgctattaaagctccgataaggttgaataaggtacagtaaagtaaaatctcagccgtttttctccaagaaatttttttcaagaaactaccagcagtcaagaacatcatgtttgatgttaccaactcagcattcaagaaaacaatgtaggccaagccccaagcaaagacaaatgggaagaggaagcgtccactacctggtgcaattttattaatcaagtcagccccaactgcaccagcagcagtactgaaggttaaaaatgcacctgcgaacatagaacgaatcgcatacttaaatttgctttgactataaagactttccttcttcttgcaagcaaattcaatctttgagataaattctgaagaaaccataataaactcctaaaatttttttacctgataattatatcacaaactttagaattaaggaaacgttttctgtatttcataagagtttattttgaaattcaatctataaaaaatcagtaaaacctaagattttactgatttatctttaataacgttgtttatatggttgattgaaagctgttagaatttcttcaggtgtttgtgaataatcttttgtatctttcaagtcaccttttacgataatacgttctgtcgcatcatagtcaacacaagttacaagtgtgatttcatcaactccagtacggtcatcaatctcatcaacgcgatctggagtcacatgcttcacttcacggatttcataggtataaactttatccttatcagtaagataaattttcatcccatttttagcgcgtgataatggagaaaagagcatttggctggcgttttccgccgtgaagatgtgaaggctcgcaagggtatagtttcctttccccatcacttgatcacgcttcattgtaccagctccatagaagagattgacattatcaagccccttaaaaataggcaagttaatttctacctcagggacagcaattccaccgataactggcaatttttgcgaatcccattgtgaggataagacagcttctgacgagatggcttttacggaatcaaagtcaaaattcccttctgtatcttgattttcttccaatttttcttttgatacctggctgacttggtatttattggtattccaaaccatgaacatatcacgaatttttgaattgaaaatcaaagctattgacaagatgattaagaatcctgccaagatattgattagtaaatttttacgatttgttttctttttattctttttatgagacattatgcttcaccttctgtttcgttttctgtcccaacttcttctttttctgcagctgcaaccgtagtaaaggttacaattttagcatcttggtccaggcgcatcactttaactcccatagttgagcgacctgtttgtgaaatattggcaacgttggttcgaatcatgacacctgtatcagtgataatcatcaaatcttcatcgcctttaacggtcataagaccagcaagagaaccgttcttttctgtaatcttagcggtttgcatccctttaccaccacgacctttagttggatattcggtcgcaactgtgcgcttaccataccccttttctgtgatgataagaacctcgtcctggtctgtaatcacactagcaccaacaactgtgtctccgtcacgaaggttaacacctttcacaccagtggcgatacgactcataccacgaacggctgattgattaaagcgaattgaataaccaaacttggtaccaatgataatatccgtgtcctcttctgtcagtaagacattaatcaactcatcttcatccttgaggttcaaagccttgagtccattctgacgaatattagcaaattccttaacgctggttctcttcacaataccatgacgggttgtgaagaagaggtaagcatcatcactacgttcagactcaacattgatgatggtctgaatactttcaccttcatccaatttcaaaagattgacaattggcaatcccttggcaatacggccatactcaggaatttcatagcctttcaggcgatagacacgtcctttatttgtgaagaagagcagatgatcatgggtgctagttgacactaattcacgaacaaaatcgtcatccttaacaccagttccttgaacaccacgacccccacgtttttgagcagtaaactcagcttggtccagacgtttgatgtatcctttattagaaagagtgatcaagacatcagcttcttcaattagatcctcatcttcaagactcaagacttcaccgaccatcaattccgtacgacgttgatcaccaaacttacgcttgacttcatctaattcatccttgatgatttgagaaacacgttcgggcttagcaagaatatctgctaaatctgcaatcagagccaagaggtcatcatactcagactgaatcttatcgcgttccaaacctgtcaaacgacgaagacgcatatcaagaatggcttgactttgacgttcagaaagcttaaacttactcatcaactcagcttgtgcttcagcatccgtttcactagcgcggatgatacgaatcacttcatcaatatggtctagcgaaatcaagagaccttctaagatatgagcacgcgcttctgctttttccttatcaaaacgagtacgacgaacaaccacttctttttggtgctcgatataagcatccaaaatctgacgaagggacaaaatctttggtaccccattttggattgcaagcatattaaaaccaaagttggtttgcatctgggtcatcttgaagaggttgttgaggataacattggctgaggcatcacgcttgacttcaataacaaatcgaacaccttcacggtttgactcatcacggactgctgtaatcccctcaatacgtttttcctgamccaaacgaacaatatgctcatgcacctttgttttattgaccatataaggaaattctgttacaacaatacgctcacgtccagtcttagtttcttcaatttcagtacgtgaacggaggacaatcgatcctttacctgtttcataagccttatgaataccggatttccccataacaagagcaccagttggaaaatctggcccaggcaagacttccatcaagtccttagtggtcacttcaggattgtccatgaccaacttcactgcatcaatggtttcaccaaggttatgaggtggaatattggttgccatcccaaccgcaataccagttgctccattaaccaaaagattaggaaaacgcgctggcaagaccaagggttcacgttcattggcatcatagttatcaacgaagtcaactgtatttttgttaatatcacgaagcatctccagagcaatcttgctcatacgtgcctcagtgtaacgctgggcggcagcaccatcaccatccatggaaccaaagttcccatgaccatctacaagcatgtaacggtaactccaccattgagccatacggaccatggcttcatagatagaggaatccccgtgtgggtgatatttacccatgacatcccctgtaatacgagcagattttttatgaggtttgtctggagtaactcccaattcattcattccgtagagaatccgacggtgaacaggtttcaagccatctcgaacatcaggaagggcccgcgctacgataacactcatggcgtagtcgataaagctcgtcttcatctcctttgtcagattgacattcactaaatttctatcctgcattaataaatgcctcatttcactattagtaattaactatattataccataatgtccgctatatttcagacatctaaaaccactaaaacgtttacatcaagaactgaaatgtatatccgtgacaaagcttttcaaaagtgataaaattgaaataactggggaaatccctgaataaaattaaggagatgtttagaataatgacttcaactaaacaacacaaaaaagttatccttgtcggtgatggtgctgtaggttcttcttacgcttttgcacttgttaaccaaggaattgcacaagagcttggaattatcgaaattccacaattgcatgaaaaagctgttggtgacgctcttgaccttagtcacgcccttgccttcacttcacctaaaaaaatctatgcagctcaatactctgactgtgcagacgctgaccttgttgtaatcactgcaggtgcgcctcaaaaaccaggtgaaactcgtcttgaccttgtaggtaaaaaccttgctatcaacaaatcaatcgtaactcaagttgttgaatcaggtttcaaaggtatcttccttgttgctgctaacccagttgacgtcttgacttactcaacttggaaattctctggattccctaaagaacgcgttatcggttcaggtacttcacttgactcagctcgtttccgtcaagcacttgctgaaaaattggatgttgatgctcgttcagtgcacgcctacattatgggtgaacacggtgactctgagttcgctgtttggtcacacgctaacatcgctggtgtaaaccttgaagaattccttaaagacactcaaaatgttcaagaagctgaattgattgaattgttcgaaggtgttcgtgatgcagcctacacaatcatcaacaaaaaaggtgcaacatactacggtatcgcagtagcccttgctcgtatcactaaagcaatccttgacgacgaaaacgcagtacttccactttcagtattccaagaaggtcaatacggagttaagaatgtctttatcggtcaaccagctgttgttggtgcacatggtatcgttcgtccagtaaacattccattgaacgacgcagaaactcaaaaaatgcaagcatctgctaaagaattgcaagctatcattgacgaagcatggaaaaatccagaattccaagcagcttctaaaaactaatttagatagaaataactccttgagtcatcagggagttattttttatctctatcttaactaaacattttatgaagtttacgtaaaaaacaacataactttaaaagctatcatatcacagtttgagcataaatccgaaaactaccaattagatctatcctcacgttacaaaaagtctgtagcaagcagtatttgacgaacttgataccgtcgcattaaatcgaaagtaaaaaagttttgccccctttttgccacctagacaaaaaaagagcccatcatacaggctagaaagcttgatatgataggctttttttaattttgattaacgtactgtacggatacgcattgtgtttgtacgaacagcttctccaactggtacaccagctacgataacgatatcgtcaccagattgtacaagtcctgcttcaactgctttacgttcagcgatttcgaacatatcgtcagttgaagatggagcgtctgtcaacattgggataacaccccagttcaacatcaacccacgttctgtcaattcgtcgaatgtcaatgccaagatatcagcatttggacggtatttagagatcaaacgtgcagtgtgacctgtcttagtaagagttacaaccaatttaatgtccattgagttagtagcatcttaaccagctgaagccattacttctgtcttagagttacgttcaaatgaatctgagttcaaacgtccgtattcgttaagaagagtttgagcgttcttgtcgattgtagccattgtagttactgactcaagtgggtatttaccatttgcagactcacctgaaagcattgttgcgtcagttccatcgataacagcgttaaatacgtctgatacttctgaacgagttgcacgtggtttttcagtcattgtttcaagcatgtttgttgcagtgataacaactttacctgcagcattgactttagtgataatcattttttggtaaactggaaccatttcgaatggtacttcgatacccatgtcaccacgagcgatcatgataccatcagcagcttcgatgatttcatccaagttatcgataccttgttggttttcgattttagcgaacaattgaacatgtccatttccagtttcttcacagattgcacgaacttcgttaacgtctttagcagtacgtacgaatgaaatcgcgatgaagttgataccttgttcaagaccgaagcggatatcatcgttatcacgatcagcaagagctgggaaaggaattttagtgttagggatgttaacacctttttgtttagcaattacgccatcgttttcaacttcaacttcaaattcacgagttgcatcatctttagcaaccacacgaagaccaagtttaccatcgtcaaccaaaacttgacgaccaacttcaacatcatcatagatatcaagagcaccagcaacgttcaatgcaatcacatcacgagttgatttgattccttgtttagtcgcaacacggattttctcaccagttttgtatgaatactctttagcttcaccttcgaacaattctgtacggatttctggtccttttgtgtcaagaaggaaaccaacttttttacctgcaagtttttctg

SEQ ID NO: 63 - DNA, 112014 bp, Streptococcus mitis NCTC 12261 contig9
gagtctaggacttcgcgagcgtaaacatcagtaataattgacattttttactctccttatgagttaaattttttacacctctataataccttaaaacccctcctttttcaagaaaaaacgttatctttgtgcaaattttccttaactttataaagtaatcgctttcttttgtctgttttattctaacttttatgatatactgttttcatgacagatttatcaaaacaattacttgaaaaagctcatggtggaccaaaattaaatccagatgagcaaagacgctatcttggcacttttgaggaaagagttcttggatatgcagatattgacacagcaaatagccctcagttagaaaaaggctttttatctattttagaaaatcttcaggaaaaagcagaaccactatttgtgaagatttcaccaaatatcgaatttgacaaacaagttttctacttaaaagaagcaaaagaaactgatagtcaagctaccattgtatctgaagagcatacttcttctccttttggccttattatccacaccaatgcaccagttcaagtagaagaaaagaaccttcgacttgcttttgcaaaactttggaaagttaaaaaggaagaaccagccaaaacatccttctggaagaaatggtttggctaaatattgcgcatatttaataaatgcccaatattgttagccgtgcgctccagatagagactggcatttttcaaactatcttctaaaggttcgcttttctctaaaatagaaaaggtagcttggatattttcaaatggtagtgaaggtaaatcttcagcgagactaccgcaaatagcaataacaggaactccgacaggggttctttttgctacccctatcggcgctttccctgctaaactttgacgatctagccttccttctccaacaataaccaagtcagcatctgaaactttcttatcaaagtcaatcaaatctaaacaagtgtcaattccagatacgatacttgcttgagcaaaggcacacaaaccgccagcaatgcctccaccagctcctgctcctttaatttccaatgttacaggtgaggctttttcataaaaatcttggattgcctgatctacgactgcaaacatagtaggatgtaaacctttttgtttgccaaaagtgtaagtcgcaccttgataaccacataagggactcgcgacatctgctaaaatacggatttgaacaccttcaggaatttcatagcgattttctgttgacatagaagctaagtttaataaggactgaccgcaagcgggcaagacatttccatccctatcataaaatcgataacctaaaccagcagtgatcccaattcctccgtcattactggccgtgccaccaacgccgatatagatttctttaatcccttgagcaatgagatgacgaatcaactctccaataccacaagtttggatttgaagtggatttcgtttctctagcggaatttttccaaggccaaccaagtcggcaacttcaaatagtgccagttgacttttttgaaaatagcgcatggcttctttttgtccaaaaggtcctgtaacttggatccatttttcttcaaggtcaagagaatgtcgaatggaatctacagtgccttctcccccatccccaacagggcagaggagacagtctacatctgctatcgattgttggaagcctctttttattgcttcagctacctgttgagcggacaagctttccttaaacgaatctggtgcaattacaatcttcatattttccctcattctaaacagtcaatcaagggaagaacttctaaaaaatccctcttgtcaacatggtttggtatttcttgtttcagtacttctttggcacaaaaagcaattcccagtcctgctgacttcaacattaataagtcattggccccgtcaccgattgcaacagttctttcttgaggaagttttagttcctctctccatttttccagagtctcttttttgacctcaggacttataatttgtccaatcaattttccagttaaaagaccatctttgacttcaagttggttggcagagaaatgggcaattccaagtgattttgctaatctatcaactattggtataaatccaccggacaccagaccaactaggattccattcttttggagaatagagataaatttctgtgcatttggcgatagatgaatagagttgaatactgtatcaaagaccgaatcagggaggccttttaacaaagctactctctctcgtaaactcgtttcaaagtctaactctcctctcattgcccgacttgtaatcagcgaaatttcctcctcacgacctgcctctcttcccaaaagatcaattacttcttctaggagtaaggtgccgtcaacatccataacacacaaaccttttacttgagacatcagttctcctctctaaacagcccaaaaatcgtatgaagtcatcatacgattttatctattaattaactaaactatggtacaactcaaggtatgacctgcaggctgtatcccacgagaaatcacactccatagcttgtttttgtaggtttctccaaacatcaggatggtttctatacaagtccaaagctgtttggaaagtccaatttaaccagtaaggagataaattgtcaaagctaaagccagtaccgcttccttcgattggattgaaggctttaacggtatctcgcaagccaccaacttcatggaccaatggcaaggttccgtaacgcatagccatcatctgagacaaaccacacggttcaaaacgactcggcatgaggaagaggtcgcaagcagcgtagatttcttgagcaagtttgacatcaaaagtgatatttgctgatagcttgtctgggtaaatctgagcaaaccacgagaaagctccttcaaaggctggatctccagttcccaaaagaacaatctgaacatcattttgcaagatatggtgaagactttccaccaccacatcaaaacctttttgacgtgtcaaacgagaaacaattcccaccagaggaacgtcagctctaactggcaagccaactctttcttgcaattttgccttgttttgggctttaccagacaaatcgtcctgattaaaatgataatctaaaagagcatccgtctgaggattataaaggtcagcatcaatcccattcacgataccagacaccttgccagactccattcgaagaatctgatccaagttacatccgaactgactggtcataatttcatgagcataactaggtgaaacggttgaaacacggtccgcatagagaatacctgccttcatccaattcagacagttgttccagcgaagggtgccatcagcgtaacgttcaaagccgactccaaacaaatcccataacattccttctgaaaattgtccctggaattctaaattatgaatggttaaaactgttttaatgccctcataggcttgaatccaacggtatttttccttcaacaagaaaggaatcatagctgtatggtagtcatgaacatggagaagttcaggaataaagtcaatcctttccatagcctcaatggcagccagttggaaaaaggcaaagcgttctccgtcgtcaaaatcaccgtaaacatgaccacggaagaaataatattggttgtcaataaagtagaaggttacaccgtttaaaacggttttcttaattccacaatactgtctgcgccaaccaacactcacctcaaaatgaagaacattttcaatctgatttccaaatttagcctctaccatgtcatagtagggtaaaatcactgcaacttcatgtcccgcttttactagtgatttgggaagagcgccaatgacgtctcccaaaccacctgtttttgaaaagggtgcaccctctgctgctacaaataaaattttcatgaatgaatatcctctgttactttagcacctttcttaacgacgactggatgttctgcagttccacggatcacaactccatccgcaacttcaacacccttgtccaagatagcatattctacctgagctccttctccaataacaacacgagggaataagatgctatctttaaccaagctatccttatggacatgaatattacgtgataaaacagaattagccacttgaccttcaataatactaccagaggcaaactgagaagtgcttaccttggatgtattagcataataagttggctcttcgtttttgacctttgtataaatcttttgatttggtgagaagagagagtagaatttttgtgattcaagcatatctttgttagctttgtaataagactctacagagtgaatgttggctaggtagcctgtgtactcgtaggcaaaagccccttcttttgcagccaaatcccgtaaaacatagcgcaacttctctggatgttcttttttagcttcttcttccaagcgttctatcaaccaaggtgtatcaacgacaaagatatctgtagacatgttatagatttgatctggtaacttgctatcaaagagtttatgagaacgaacatggtctgtttcatccacttccaagattgcgtttacttctgaaatgtctttcttagatagttttttataaactacagtgataggctcttttgttgtactatgtagatggaaaacttggttcaaatcaatattaatcaaaacatcacagttaagtgaaactgtttggtttgagccagaacgtttcaaataagtaagaagctgttggtagtattcttttccaactgtactactttccacacgggtattgtaaatacctagatagtagtggctaagaagagttgacaatccccactcacgaccagaacggatatggtcaaagactgagctaatattatcttgttggaaaataccaaagatactacggacaccagcattagcaagacttgaaagtgggaagtcgatcaagcgatatttaccaccgaaaggcaaactagccactggacgatggtctgtcagtgttgacatatcatgaaaaccaactgtgtttcctaaaatggcagaatatttatcaatcttcatctgttgctacccccactacttcatcatatcctacaacctgtacttcttctgtcccatcaatttcgacaccatcagaaataactgcaccttcaccaataatggcacgtttgattttagctccctgaccgacaattgcaccactcatgataactgaatctactacttctgccccttcgcgaacttgcgcacctgttgagaggatagaatgtttaacagttccatctacgaaacagccatcgacaaccaaggaatcttccacatgagcatttgccccaaggaagtttggtggtgaaattaagtttcttgagtaaatcttccattgacggttacggctatctaaggcattttctggagaaatatactccatgttcgcttcccaaagagactcaattgtaccaacgtctttccagtaaccattaaattcataggcatagacactttcacctgactcaaggtagtttggaataacatttttaccgaagtctgacatatcgactttgctcttttcagcaacaataagcatattgcggagacgttgccaatcaaagatatagattcccatagaagctttggtagatttaggttgagctggtttttcttcaaattcaacaatacgattgtttgcatctgtattcatgataccaaaacggctagcttccttaagaggaacatcaagaactgctactgtcaaactagcattattatccttgtgagactggagcatatcatcataatccattttgtagatatggtccccagatagaatcaaaacatactcagggtttacactgtcgatataatcaatattttggtaaatggcgtggctagtcccctcaaaccaacgatttccttcacttgcagaataaggttgaagaatagagacaccagaattgataccatctagtccccagcttgaaccattaccaatatggttattgagagcaagtggttggtactgtgtaatgactccaacattgttgatgcctgagttggcacagtttgaaagagcaaagtcaatgatacggtagcgcccaccaaattgcacagctggttttgcgatgctttgagtaagtttaccgagacgagttccttgcccaccagcaagaatcaaagctaacatttcattcttcattttctactcctttttggtttttacttgtgacggttttagtaggtttcaagcgacgtttgattttccaaacacttgctcccatagccggtagggtaaaggtcaaggtctgctcataatctttccatagcccttcttgcgtttgcacagtttgattatgttctttccaaacgcctccccactcttctaactcagtattccagacttcttcgtaaatccctgcaacaggaagtccgattgtaaaatcttttcgttcaacaggtgccatattaaagatacagactaacatatcatccttcttacccttacggatgaaggaaagaacactctggtctcgattatccgcatcgatgatttcaataccatcatagctggtatcaatttcccacagacagcggtggtctttgtaaaactggtttagctgagaagtgaaatacttcatcttagcattcattggatcttctaggttagaccattccaactgctcttcagatttccattctaggaattggccgtattcgctacccataaagagcaatttcttaccagggtgacaaatttggtaagtgtagagattacgtaagcctgcaaattgattgtagcgatctccccacatcttgtgcatcatactcttcttgccatgaaccacttcatcgtgcgagaatggtaggagatagttttcattgaaaacatacataaagctgaaagtcaccagattaaagtcatatttacggtaaatcggatcttcttcgtagaatcggaggatatcattcatccagcccatattccacttgtagtcaaatcctagaccatctgaatccttagtgtcagtaatctgagtagctgatgaactttcttctgcaatcatcatcacatctggatgagctagtttaatcacattatttaagcgttgaaggaaataatagccttcatagttgagattgccaccatctttattaggtgtccatggagcatcatcgtagtcaagatagagcatattgctaacggcatctacgcgaataccatctagatggtaaaagtcaatccaaaacttgatactagaaatcaaaaaggactggacttcattctttccaaggtcaaaattgagagctccccaaccgtagttatgagccttattatggtcttggtattcaaaagtcggtgttccatcataataggccaaggcatcatcattgatagtaaagtgaccaggtacccagtctacaataacgcctatattgtttaagtgacattcctcaacaaaatcttgaaattcttcaggacgaccataggcatgctctagagcaaagtaacccataagctgatagccccaactcaaacctagtgggtgagacatcaggggcataaactcaatgtgagtataattcatctcaaccaagtaaggaataagttcatctttcaattgagcaaaactataggggctgccatccggatttctcttccaagagccagcatgagcctcataaatattgacaggacgctcttcaaagctcaagcgttttctacgggctagccagaggccatccttccatttcttttctggaatatctgttaaaatagccccagtaccaggtcgtgcctcatatcgaacagccaaagggtcaatcttcatcagttgatgaccatttgcacgcgtgatatggtacttataaatttggccttcttgagcaagactggtaaagacttcccagactccaaattcattccgttccatcggaatttgattttcaacccaattggtgaaatcccctaccaagtgaacagcctgagcattaggcgcccacacacgaaaagtatagccatactctccatttttttcttccctatgagctcccagatagtgctggaggtgaaaattttcacctgtcataaaggtttctaaagcattattcttatccatacaccctcctatttctgtaagcgttttctatagatttattatactacctttttagggaagattcaagtaaattacggaatttgcaaaaaaatcttttgaaagtcttcaacaaattcactgatgtgttcacttgtaaatcaagaaattttcagaaacgctttgaaaacgaattgtttttttataatactatcataaagttcgttatttagctaacaaaaatataattttaagtaaaaaaataaatcaggaaacgaatctcctgattttacatttcatttcacatcaaaaacaatggatttgacatttgtcatcgcttcaatactatatttaattccttgcactccagcgccagaacctttgacaccaaggaatgggaaattatctggaccacgctgggttttattatttatatgaactgtacccacttcaagtttttcagcaatttcaaatgcttttttgaaatcatttgtaaagactgaggattgaaggccgaattcagattcgttggcaaaggcaatggcttcctctacactagccacacggataattggtaaaacaggaccaaatggctcttcccatgccactttgatatcttttgtaacttggtcaaaaagcactggccatagaagattgccttcgcgtttgattggtgtaagagcctgagcacctttttcttgtgcatcatcaatcaagccccaaataaagtctgctgaagcattgtcgataactggtgtgatatcagcattgtcgaatggatcgccaactgttaatttagtaacctctgcttgaagcaaagcagctagtgtatctgctacactttcgataacaataacacgtttaatggctgtgcaacgttgacctgaatagctaaaggcacccgcaacaatttgcttggcagcatgttccaaatctgcatcttctagtactaaggctgcatctttcccaccaagctccaacatgattggacgcataccagctaaacgaccaatacgttctccgataggagttgaacctgtaaagttgatgaagttgacttctttgtgttcaatgatataatccccaatttctgaaccacgacccgtaatggtattgaaaacaccagccggaatccctgcttcttcaaacgctttagccaacaagagcccagaaatagaaccttgtgttggtggcttaaacatgactacattccctgcaatcaaggcaggtgcaattttagaagcagataaattaactggataattaaagggagcgatagccagcacgacaccaactggctcgcgacgaacaacggccaatttatttttacttgctgcttcaaaaccgccaccttccattgcttgtccagtgatacggagaccttcctcagcagcatagcgaatcaagtctgcggtacgcaccacttctccaatagctgctttaattccctttgccacttctttggcaagtatagtaccaatttcttccttatcacgttctaaaatagctgctgttttgtgcaaataagccgcacgttcaactgctgataaagctcgccaagctggcagggctgcacgcgcagctttcatagcctcatctacttctgcctgagtcatagctggaacagtccctaattcttcttggtttattggtgaataaatcgtaatttctttttcagctgatttccattttccatttactaaattctgatatcttgtcaaattctcgtcctcctgaaaatgattaagatatattttaccaaattttcagaaaattacaaccctttttgcaatttttttgagattattttcacaagcttggtttttcaaactatttgaaacttgattctaatcttcattgaaaacttataaatgataaaaaggattagacaatctaaccctttttagtttatgcatttaagagagtacttttagcactgcgacactagtatcatcaatgacattttcttgtttcgaacgactattggtcacaagcatttctagatttcctgcattttcaaagtataaggaagttcccttggcattgaatactaccaatagatgttctggccccccgtgaatctcgtaaacaatccatccgctattttctgcagctgtgtgaacaaagacatgacggtaaacttcttcgtatgtaggataagaaaaggcgctagtctgtgttttcagtcgaataatttgacggacaaagtcaatgctttcttgtctttcattgattaaatcccagtttatttggttaacactgtcaggagcgttgtaactattcatagcacgttctcggtctgccgaagtgagttgtccatgttcacccgtcggaattaatttggttcgaccaaattcttggccaatttccataaaggacattccttgcatgagaaggttcattgctgtcgctgtctcaaccttgcgcataatctggtctgaactttgatcaggatgaagagtcgccaacaaatcatgaagattgtaattgtcatgggcttcaacatagttgagaacctggtttggactgagataagaacccaattctcggctaccaagaatggccttggcaatgattggttcagtggctgcaccacttacaaatcctgacttgattgcaccataaacttctcctcctttgaccgcatcacgctgattatcattgaagaatccgatatttggcatttggtaggcattatccttcttggccttatcataagttgcaagacctgttcccatatcccagccttctccataagtgataatacagggatcaacctcatctagcgcccaacgaatcgcttgcatggttttgacatcatgaatacccatcaagtcaaaacggaagccgtcaatattgtattcctgtacccagtatagaagagaatcaatcatgtacttgcggaacatttcgtgttcactggctgtttcatttccaacacctgttccattctggaaggtaccgtctggattcatacgatagtagtaatcagggacagttgtttggaaaggtgcatcaaccgttgaaaaggtgtgattataaaccacgtccataatgacaccaatccccgcatcgtgataggcttgaaccatggtcttcaaatcacgaatgacctgccctggatcatctggattactagaaaaacttggttctggtgcattgtagttttgagggtcataaccccagttataggttacatttccatcctcatcgtattccttatggcgatcaaagataggctggagttgaacatagttgcagccaagttctttgatatagtcaaaggcggttgcttgtccgaattggtttacagttccagtctgggcagcaccaaggaaggttccacggagatgctctgcaactccagaggtcggagatttggttaaatctcggatatgcatttcacagataactgctttacatggattttccaaacgccaaggcgcttctgttccatgtttgaccacaaatccttctacttgtctgtcttgatgagaaagaattacggaacgtttgccgtcaggacttgtggcaatcgtgtaaggatctctcgtcacagtctggtggtgaggaaagtcaatctgatactgataagccttgccagcaagattttcatctaagtctagactccaaacaccaatggtattgtacttatgactgtatgaatagctattaccacgctctagattaaaggttttccaaatcggagcgtcgttgctggtattttcgtagacaaccacctgtacagcagtagccgtaggagcccaaagtttaaagctagtctgataatctgaaagactgtaacctagttctccttggtagccccagtggtgatcaaaactagcgctatgtattgctctatcaaaagcaaatggattttgatctttgtagtaaggactagcaatggctgggttttcagaataataaacagtctcgtcgccctctaaaatccaaacttctgtcagaagcggatagtagttataacgcacggaatattccttaactgtcccatcaatctcgacagaaaacttcaggttttctaacttttcttgacttgtaactgtgaaggagaactttgctccaaaaaagttattttcataatacaatttttcaacattgtccgcctgttttctactaaatgaacaggctgcataatccccgttttttcgatgaaaatggatgactacagggtaattaaacatttcttttcctaatttctaattttaatttaattttttatgtggtgctgatagattcagcgatttaatttcttactcaagatagactcaatccatgtcaaaacactttaggaaagacagtttcagactatctaacacctagccttctactattctttataaactttctagccaagcttcatctcgaacctcaataccaagttcttgtgctttttgaagtttacttccagcatctgctcctgcaacaacgaggtctgtctttttagaaacactgcctgtcactttggcacccagactttcgagtttacttttagcttctgagcgcttgagtcgctccaattttccagtcaatacaacggtcaagcctgacaaggctgcatctgccactacagtctgacctttatagtccagatttaccccagcttctttcaattctcttaggagaatttcagagccttctgtcgcaaaataagtctgaagactcttggcaatcacaccacccaaactctcaatactagccacttcctctggatctgcctgagccagattttcgattgaatgaaaatgttgaagtaacagctgactggccttgcttccgacatgacgaattcccaaaccaaataagagcttctcggcagaattttccttagatgcttgaatagcttgatacagtttagaagcagacttttccttaaccccctctaaaaggaggaaatcttcttcttgtaatcggtaaatatctgccacatccttaaccagattagcagcaaatagcttctcaactactgatggaccgagtcctgtaatattcatggcatctcgagaagcaaagtgaatcaaaccttccataatttgggcagggcaacgcggattgatacaacggagggccacttcatcttcaaagtgcaacaagtcagagttacaacttggacagtttgtagggatatctagtttttcttcagaaatccgtttggactctactacacgtaaaacggcagggataatgtcaccagccttatagacgataaccgtatcatctttgcggatatctttttcagcaatataatccacattatgcagagtcgcacggctaacagttgtaccagctagttgtactggtgttagattggctgttggggttacaacacccgtacggccaactgtccaatcaactgataagagttgagcttctttttcttcagctgggaacttgtaggccactgcccactttggagccttaacggtaaaaccaagttcttcttgacttgctaggtcgtttaccttgattaccactccatcgatatcataaggcaggttttcccgttcctgtcctacttcttggataaaattccagatttcatctatgttttctgccaagattcgcttaggattaaccacaaaacctagttgttcaaggtgcttcaacaccttttcttgactgtcacgagttgaaagactggcttcttgatagaggaaggtagcaagattgcgcttggctactactgccgtatccaactgtcgcagggtgcctgctgccgcattacgaggattggcaaattcaggctctccattttcttgtcgtgcttggttgacctggtcaaaagaagcgcgtggcatataacattccccacgaactgtgatatctagttcttctggcaaagtcaaaggaatgtccttaacacgcttgaggttttccgtgatattctccccaacagaaccatctccacgtgttgcaccaacaactaaaatccccttttcataagtaagcgatatagacaagccatcaattttcagctcacaaatataggtcggatgagccacttccttacgaacacgcgcatcaaaagcttcaagctcctcacgtgaaaaagcatcctgcaaactataaagaggatactgatgactgtatttttcaaaaccatctaaaaccttgccaccaacacgatgggtcggactatctgctaacacttgatctggataggcagtttctaactcaaccaactcacggtaaagacggtcgtactcactgtctgaaaccgagggattatcgctggtatagtactcagtcgcatagcgattgagcaaggcgaccaactcattcattcttttattcataaaactattttaccataaattaagcccttctcacaaacgagaagggcggaaaaaacacttagattggaattatttttgaagtccaagcaaacttatgtctctttttcaaaatgagttcgtacatagcctagagctaagaaggataaggcgacaactccaagtccaataatcaagaaagaataaagatggacacttggaagaaaggtcatcaaacctttcgcaagcggcataaagagaattgccagtgtaaaaatggtactcaataccctacccaaatattctccatcaatcttggtctgtacctgtgtaaagaagtgaatattaaaaatcgtcataaagagttcacaaatcaggtttccagaaaaggttaaaatattgggcagaggcaaacccatcatgaaaactcctactcctgttaaaatcaataagaacaaaagtgtattcatacttgatttaaatttatttgctatcagtgctcctataattgagccaatcgcacccatggttaagatagtcgcataagctccttctactccatatagtttatttgaaaaaggaagcaaaaactcaaaagccgcaaaaaagaaattaacgctggaagccactaacaggagaaagaaaatctctttttgatgccagatatagtgcaagccatctttgatatctgcaaaaatatctttaccagtaaaaagtttcttatcttgaaccattggttcttcttttggaagtaaggccactagaacaaatgctataaaaaaagtcaaagcatctagtaagagcgtcagatggagacttgcaaattgtaagaccagaaaagaaagtacaggagaactcacactgacaacctgcaagaccaactccaaacgagaattgtagaggaccagttcatccttctctaccaattctgtgataatggccttatttgcaggtctagaaaaggcaaaagcaatagcctgcacaatattggcaaaaatcaaagcgccaatcatccagctgtcattccttatgaaagaaatagccagacaaagaatcccacaaacaaggtctgtcaccattaaaatcctacgacgagaaaaacggtctgaaatgactccaccaaaaggatttacgagaatagatgtgaccagttcagaaatctgatacattcctaaaactgtctgtccgatagtccccatggaagccaaccagacactatttccataatcatagagcatattccctatcttgttaacagctccacggctaatcaactgtacggcatagcgattcataaaaactcctctcaaattttgaaactattgtatcaaaacttggaggagtttctcatttttcccatatttgggaaaattaatctttgacaaatttctcgtagtgttcctgatagtaggctacttgctctggaagacctagcacgtcaaaaatatgcatggcctcttgcatctgcttacagcctactttacactgtcccttttgatacaaggcaaaaccttttaaataatggaaaacattacgctcataaagtttaatacctttaccaataatcttctctgtataagtctcaaaatatcttgcattgtcaaaagaaagatgctctaaacaatgctggtaacaattaagggctaaaatcaagaccagttttctatggcgaccaatttcttgataaaatccctccctctccatcacttctctaccaattcgagtgacgtagtccacatcgtagaaactatagaggtttccaaaaagaatcaactcatacatggtccattcttctgttttgaagagataatctgctaccttatccaaatcatcccgctccatatgataactcgaatctctttgacaaatcagaccttgtagcaaaatccagttcagctcaaaataaaggggattcgtcgaactcttagccttttcaagttgttctctttgaagcttttgaaaacctgcaatatcatttgagtagtaaaggggtacaatttgtcccatcatggcaacatgttcatgattatgaaaattccttgccttgtccatgaaattttcgattgtaacatgaatgttatccaaaatctcaaagaaacgagaaactgctaggtcagactccccaagctcaaagcgagataactgggaagttgaacaggactcccctgccgcctcctttaaagaataatttccacttgttcgaaattcacgaaatacctttccaagatgttccattttacacctgctccgataattcttcccattcaagcatcgcttcttcctgacggtggctaattttgtccagttcagcctgtaattccatcagtttgtcggcatcgttggtttccaacatttgttcagaaatggcctggctttgactttctagctcttcaatttcagcttctagactttcgatttgtcgcatgagtttgcgaacttctttttgactttctttctgagcttgatagtcattaactggacttgcttcttttgcttgattagtagttgaaatttcctcagtttgaatcatttctacttctgctttcttctcgacatagtagtcgtaatctccaagatagagagttgatccattctcagacaattccagtacatgagttgccacacgattgataaagtaacggtcgtgactgacgaatagaagagttccatcaaagtcaatcaaggcattttccaacacttccttgctatcaatatccaagtggttggttggctcatccagaatcaagaagttgttgttttccatggaaagtttagccagaagtaaacgggctttctcgccaccagacagcatgccgactgattttttaacatcatctcctgagaaaaggaaggcacctagacggttacgaatttcaacttctggtgtcagtttaaaatcattccagagttcatccagtacagtattacttggtgtcagcttgctttgggtttggtcatagtaaccaacctcaacattggcgccaaagcgcttctcacccttgataaaaggaatctggtccacaatagacttgataaaggttgacttgccaataccatttggtccaacaatagcaacagcattcatcttacgaaggtctaggttgataggatctgacaatatttccccatcatagccaatagctgcattctcaacagtcaaaacaacattgcccgacgttttttcagactggaaggtcatgttggctgatttcttgccagcttcaggtttgtccaaacgctccattttttccagttgtttgcgtcgagattgggctcgtttggtcgtcgaagcacgtactagattgcgattgacaaagtcttccagagcagcgatttccttttgttgcttttcatagttttttgcctcagtagctagcttttgctcctttaactcaacaaaacgagagtagttgcccacatagcgatccaaggaatgcttggtcaaatccagcgtaattgtcgcaaccttgtctaagaagtaacggtcgtggctgacaataataagggcgccgctatagtttaccaagtaattctctagccaggcaatggtttcaatatccaagtggttggttggctcgtccaagaccaagagattgggcttttcaaggagcattttagccagtgccagacgagtattttgaccacccgaaagctcggcaattttcatctgccacatagactcgtcaaacttaaatccatttaaaatcgctcgtatatcagcttcataggtaaagccacctgcttggcgaaaattctcagataagcggtcgtaatctgacatcagtttatccaaatcagcaccagacttttctcccatctctagctccatctgacgaagttgtttctccgtccgacgcaaatcatcaaagacatgaagcatctcatcgtagatggtattttcagactcaaaacggctatcttgggctaggtaagacagagaaatatcttttttcttattgatttctccactagttggctcctcttctccaaccaaaatcttcaaaagagtagacttacctgcaccatttttcccaacaagggctatccgatctcgttcatcaacctgcaggtttatattatcaaaaagaacctctcctgcaaaagaacgttcaattttattagcttgtaaaataatcataagagtagtatagcatgtttccctaaggcattcaagacttgataaacaggcatatgtcactacttttctgaaaattatgctaccgttttactaaaacgctaaaaagtgctataatgtgaacggttaaaacaatttacaaaaaggagaatttcaatgtcttaccaagaaaattaccagaaatgggttgattttgcggagcttcctgattaccttcgtcaagatttggaaaatatggacgaaaaaactaaggaagatgccttctatacaaatcttgaatttggtactgcaggtatgcgtggcttgattggtgctggtacaaaccgcatcaacatctacgttgtgcgtcaagctactgaaggattggctcgtttgattgagtctaaaggtggaaacgaaaaagaacgcggtgtcgcaattgcctacgatagccgtcacttctcacctgagtttgcctttgaatctgcggcagttcttgctaaacacggcatcaaatcttacgtatttgaaagccttcgtccaactccagaactatcatttgcagttcgtcacctcaactgttttgcgggtatcatggtcacagccagtcataaccctgcaccatttaacggatacaaggtttacggtgaagacggtggacaaatgcctccacacgacgcagacgctttgactacatatatccgtgcaatcgaaaatccatttgctgtagaagttgctgatgtggaagctgaaaaagcttctggcttgattgaagttatcggcgaagctgtcgatgttgaatacctcaaagaagttaaggacgtaaacatcaacccagccttgattgaagaatttggtaaagacatgaaaattgtctacacaccacttcatggtactggtgaaatgttggctcgtcgcgctcttgcccaagcaggatttgactctgttcaagtcgttgaagcgcaagcaactgccgatcctgacttctcaactgtaaaatctccaaacccagaaagccaagcagcctttgcccttgctgaagaacttggtcgtcaagttggtgcagatgttcttgtggcaactgacccagacgctgaccgtgttggtgttgaagttcttcaaaaagatggtagctacctcaacctttcaggtaaccaaatcggtgctatcatggctaaatacatcttggaagcccacaaaaacgctggaactcttccagaaaacgcagccctctgcaaatctatcgtatcaactgacttggtaacgaagattgctgaaagctacggcgcaaccatgttcaacgttttgacaggtttcaaatttatcgctgaaaaaatccaagaattcgaagaaaaacacaatcacacatacatgatgggatttgaagaaagcttcggttacttgattaaacctttcgtacgtgataaagacgctattcaagccgttcttgtcgttgctgaacttgctgcctactaccgttctcgtggtttgacacttgctgacggtatcgaagaaatctacaaagaatacggctactacgcagaaaaaactatctctgttaccctttcaggtgttgatggtgctgaacaaatcaaagcgattatggctaaattccgtaacaacgctccaaaagaatggaatgcaacagctatcactgtagtagaagacttcaaggctcaaactgccactgctgctgacggtactgttacaaatttgacaactcctccaagtgatgttttgaaatacacacttgctgacggttcatggattgctgttcgcccttcaggtacagaaccaaaaatcaagttctacattgcagttgtaggtgaaaccaacgaagaatcacaagctaaaatcgctaacatcgaagcagaaatcaatgcttttgtaaaataaagccctataaaagatgagaccaaccaatctcatctttttttcgtatcaaatctaagcaattttagaaactttatggcatactagacttatcaatgaaagcgaggtaatctcatggaacaatttttagataatatcaaagaccttgaagtcactacagtagcgcgtgcggaagaagctcttgataaaaaagaaactgcaaccttctttatcggtcgcaaaacttgcccttactgccgtaaatttgctggtaccttggcaggtgtcgtagctgacactaaagctcacatctacttcatcaacagtgaagaaccaagccaactcaatgagttgcaagcattccgctcacgctacggaatcccaactgtaccaggatttgttcacattgcggatggacaaatcaatgtccgttgcgactcttcaatgtcagcacaagaaatcaaagatttcgctggattgtaaaaaagccactcatcgagtggtttttaaatggtcaaaattacgttttttcaagcaaatcttgtatcatccgatgcagttcttcgattttctcagattgtttctctattaatattctttggcccgataattcgtcttggagtttatcaagttttatctgttcatctggattatcttttacaaaaaagttcgtcaaggcacttgttaacattcctattgtactaatccctaccaacattaataaaaaagctagccatttcccaaaaagggaaactggaacaatatcaccataaccaacagtggttactgtcacaagagcccaccaaagactatctgagaaagatttttcttcaactacagataaaattgaacttcctactagaacaataaaaatattaacatacaagatataaatcaggccatttgtccgtaagaatctactaatttttctttctaatttacctgtaagtccaattattctaagtaaacgagtcagtttcagtaattttgtcagccttgctaagcggaagatacgccctaatcgcaatactgtaaaaatagcatttaaaggaaggatagctaacaagtcaaagatattttcaagtataaacctccattttgctttacttgaaaagaaccgccaactataatctaccacaaacacaaaccaaagtagcaagtcaataatactgtatggaggactgtctaaatcaatcatctcagcaaatccaagtaataccagaatatactcaactttaattcaataaatatctctccgatgaccaacttctaaagtagcaatgactaattcatcatctacaatttgtacgataactcgataattaccaattctatagcgccattgaccaacgcgattaccaaccaaagcctttccgtgtcgtcttgggtcttccaaaacattggtttgtaaatagtttgtaattatcttctgcgtataacgatccaattttttcaattgcttgatgaaacgtcttgttggaactaatttatacaaattattcatcctccaagcctaaatcatgcatcatttcttcccaagtaatgggttcaactcctttttccaagtcttctaaatactcttgataggctaaatctgccacacgagcatcgtattcatcttctagagcttcaagagttttggtgcggataagttccgacagggaaaccccttcaaacttagccattgctttcataaatgttttatcagcttcagaaacttttaatgtaatagtagtcatcttttgcactcccttttttaatagtaacaccattgtattactttttaggtgttcagtcaatataaaaagaacaccttcttagcgttctttctatatatctgtcaatggtgttgcggtatctggtgaggtatcatataccttaaagtctatcccaactccaagatcagcttgagccaactgatttaccatggtcatatgagccagttccttgatattgttctccttagataaatgaccaaggtagattttcttagtgcggtttcccaaggtacgaatcatagcttcagcaccgtcctcgttagaaaggtgacccagatccgatagtattcgttgtttgagtcgccaagcgtaagaacctgctcgcaaaatctctacatcatggttggactcgataagatagccatctgcattctcgacaattcctgccatacggtcactaacataacctgtatctgtcaaaaggacaaaactcttgtcatccttcataaagcgatagaactgcggtgcgactgcatcatgacttacaccaaaactctcgatgtcgatatctccaaaggtttttgttttgcccatttcaaagatatgcttttgcgaagaatccaccttgccaagatacttgctattttccatagcctgccaggtcttttcattggcgtaaagatccataccatacttgcgagccaacacaccgactccatggatatggtctgaatgctcatgggtaatcaaaatggcatccaagtcttctggcttgcgatttatttcagcaagtaggctggtgattttcttaccagataagcctgcatccactaaaagtttcttttttggcgtttccagataaaaggaatttccactggaacccgacgctaaaatactgtatttaaagcctgtttcactcattctggtcttctatttcgtcctcccatacttcttccttcactgcatccttatcataagggagcacaatggtaaaggttgatcccttaccatatatactcttggcccaaataaaaccattatgttgtttgataatttctttagcgatagacagtcctagccctgttccaccttgagcacggcttctagcacgatccacacggtagaaacggtcaaagatacgtggcaaatcctgcttaggaatacccaatccttggtctgagatggataaaatcatctgatcatcagtcgtcttcatggtcactgtgatttttccaccatctggagaatatttaatggcattgttgagaatattatcaatcacctgcgtcatcttgtctgtatcaatttcaatccagacagacgtaatcggataatctctaaccaattcatatttcttttcttcgtctgatcccctcatcttatcaaagcggttaagaataaaggtaataaaggctgtgaagttaatcagttccacatctaggtgactagttgcattatcaattcgagaaagatggagaaggtctgtcaccatccgcatcatacggttggtttcgtctagagacaccttgataaagtctggtgcaacaggttctgacaaggctccctcatccaaggcttcaagataggattttacactagtcagaggcgtccgtaactcatgactaacgttggaaacaaagagtcttcgttcgcgttcttccttctcctgctccgtcgtatcatgcaaaacagctaccaaacctgagataaatccagactcacgacgcaccaaggcgaagcgtacacgaaggctcagatactcaccattggcatcctgagaatcaatcatgagttcaggaacttgggtaatcaaatcacgaagttcatactcatcttcaatcttaagtaattctagaatacttttattgagaacatcttccttctgaacacctagctgtttcttagccatgtcattaatcatagtaatcttaccacgacgattggtcgcgaggactccatctgtcatgtaagagaggatactgtgcaatcgtttactctcttgttccagattttcttgggtcaaacggattacttctgataaatcattgagattattggtaatattagtgatttcagagcttccctgcatatccaatacctgagaataatctcctgcaatcaagtctttaactttttgattaatttgcttcaaccgaatattatctcgccgattttctagcaaaagcaaggtaacaatcaagataaaacccaataaaattaaaatgaagataaaatcactagtaagaatattttttctaatcaattcaatcattatttctcatataataaccaacaccacgacgtgttaggatatactctggacgactaggtgtatcttcaatcttctcacgcaaacgtctgatagttacgtcaacagtccgaacatctccgaaataatcatacccccagaccgtttcaagcaagtgttcacgggtaatcacttgaccaatatgagaagccaagtggtacaaaagttcaaattcacggtgggtcaagtctagttcttcaccatattttttagccacataggcatctggtacaatctccaagtccccaatttgcaaaggttgggttttcttttcatctgactcttgattatctacagaaaccaagtccgtacgacgaagaagagctttaacacgcgcctgcaactcacgatttgagaagggttttgtcacatagtcatccgctccaagctccaaaccaataaccttatcaaattcgctgtctttagctgacagcatgataataggaacactactcgtcttacgaatagtctttgcaacttctaaaccatcaatttcgggaagcatcaaatccagaataataatatctggttgctctgcttcaaattgttctagtgcttcacgaccattaaaagcagttacaacctcgtaaccttccttggtcatattaaacttgataatatccgagattggtttttcatcatctacaattaatatttttttcatttgttcacctttttctctactattatatcaaaaaaataaaaagaagacacaatagctagtctttactactgtctaagttggcttgtgcataagcctgccagattttttgttggggtttggcaagtgggtaattcttaaactcttctggtgaaagccagcgaacttccctatctggaaagtcattgtagtcactcacctgacctgctacaatttgaacatgccacttacgatgactaaagatatgcttgacagtctcaaaataaatatcaagccaatcaacatctaggtcatagtcctgctggaaactctcttctggactgggaccaaagttcacgctttcttctgcaacctgatgaaagaggtcaaactgctctccttgcgaaaagttatcaacttctatcaaggggaaatgccaaaaacctgccaatagcttttcactttcatttttttcaagtaaaaattgtccctgagtatttttgaccaccaaggctttaagataaattggaacaggctttttcttgggagccttaattggataacggtccattgtgccattctgatatgccgcactaaagtccttaactgggctttcttctggtctgggatttacaggcgcctcaatatcagatcctaagtccatcaaagcttgattaaagtcaccaggcctttctgggtcaatcaagatttccatcattgcctgaaaaattttacgattacttggaatcccaatatcgtgattaacttcaaatagacgtgccaaaacacgcatgacattaccatctacagctggctcaggcaagttaaaagcaatactggaaatggctcctgcagtgtaaggtccaattcctttcaagctggaaattccttcataggtgtttggaaattgaccaccaaaatcagtcataatctgctgggctgcagcctgtaaattacgaactcgagaataataacccaaaccttcccaagccttcaacaaacgctcttcaggcgcattctccaaactttctactgttggaaaccagtccaagaatcgttcgtaataagggataaccgtatccaccctagtttgctggagcataatttcagacacccagatatgataaggatttttacttctacgccacggtaaatctcttttgttttcatcataccaagcgagaagtttctcacggaaagaaatgatcttctcctccggccacatgacgataccgtattctttcaaatctaacatatctctagtataacacagaagattctaactgtccttttcctagtattagtactcttcgaaaatcaaattcaaaccacgtcaacgtcgccttgccgtactcaagtacagcctgcggctagtttcctagtttgctctttgattttcattgagtataaaaagcctcttcccaaaggaaagaggactaaatcttattgatgaacagcttgggctgctgtgataagggtcaacttgtaaacatcatctgcattacatccacgagaaaggtcgttaactggcttgttcaaaccttgcaaaacaggtcctacagccgcaaagccaccaaggcgttctgccatcttgtaaccgatatttcctgcctcgatacctgggaagatgaagacatttgcttgaccagctaccgtacttccaggagctttcagagctgcagtttcaggaacaaaggctgcatcaaattgcaattccccatctatttcaaggtcaggacgcaagtcgtgagcaattttagttgcttctacaaccttatcaacactttcaccaaaacctgaacccttagtagaataacttagcatagcaattttaggttcgatgccaaacatcttagctgtgattgctgagttgattgcaatttcagccaaggcttcagcgtctggattgatattgatggcacagtccccaaagaggtaacgctccgtaccacgaaccatgaggaaggcacctgaagtacgagttacatttggacgagttttgatgatttgaagagctggacgaactgttgaagctgttgagtgaatcgctcctgacaccattccatcaaccaagcccaagtaaaccaacataacaccaaaatagttgacatcttcaaccaaaaccttgcgtgcatcttcttcagacattttgcccttgcgacgctccactaaagcagcaaccatttcttcaaatttatcgtagtgttgagggtcgatgacttcataaccgtcctcaataccttcgatttcaagataaattttaattttttcaggatttccaagcaaaacaggaatcacttctgtttcttttaccaggcgtttagtcgcttgaagaatacgaggttcttccccttcagggagaacgatacgagcatttttaccaaccaagttggctttgagactttcaaaaacttccatgagttttctccttttagataataattatactctgaaactgtttttatagagtattagttgataactgggtaataaggttgctaaaatcattcggcaagggactttctaactgcaagtcttgctctaaaaatggatgataaaaagataggtaatggcaatgcagggcttggcgctgaattccatcgtctagactaccaccgtacaaatcatctcccaacaaaggaaaaccaatatgagaaaaatggactcggatttggtgggttcgcccagtgtgcaggcgaatgtctaccaaatgaatattcccataagatgctacaatcttgtaagaagtatgagcatactttccacctttagccacccgtctagtgataatagagtcttcatcacgcgcaatcggagcaataatttctccctcttgctccaagtgtccatcacctttaaccaaagcaaagtagcgtttttcaatggacttcttctgcaactgcttgtctaatcgtgcgtgggcatagccgtgcttagcaaagagcatcaagccagaagtatctctatcaagcctagtcacaatgtgaacctgctgattttcatagttttgcttgacgtagtaacccttaataaaattggcaatggtattagagtggttgacactaggaatagaagccactccatagggtttattcaagactagaaaatggtcatcctcatagagaatgtctaatggtctctcgatagcttctagagtttcaaaaccttcctcagcgggaatatcaatggcaacgcggtctccaatgtccaatagatacgtcgcattttgtggttgatcattgaccaggatagctccgcctcgaaacttaatcttagccaggagccccttagaaacctcgtgcttttttaagaaggtcttaaccttgacatgctcatctgcgataaattcaaacctcattcgtccacctctccgataaaagcatccttaactcggttccagaaactggtatggctcggtgatgcgacaaagtgaatcttatgatggtcgatttgatactcaattcgttcaatattgcggaaggaataaacgctattgtcaaccgaaatagtatggtaatcgtttctcgtcgggataagttcaatcttatccttctttggaacaataatggacgaacccagcgttcgatagacacgattgttaaggctggcaatttccgttaattgcaaagcttcaatggttgggtgtaaaacagctccaccgagcgacttgttataggctgtactaccagtcggtgtcgaaactgttagcccatctccacgaaaacgttcaaagtggacaccgttaatcacaacatccgccaccatggttcgatcagacctgcggatgctggcttcatttaatgctctgaaaatcttcacttcaccattttcaagaaagaccttcacatttagaacagggtaagagactcttgctccggtatctagctgcaaattagtcactagcttatccaactcaaaatcacggtagtccgtatagaagcccaaatgtccagtgtgaacaccaatgaagcggaccttgtcaagctggttttcgtacttatgaaaggccgacaagagcataccatccccaccgatggaaataacgatatctggattggtatcattgagtataaactgatttctcttcaaacgatctcgcaattcatacaaaaccctttgactctgcggttttctattagctatcaggtcaattcttttacctgtattcttcatctgtatcgtcactgtttcctacaccatcatttaattttctactcaaaggatcaaaaagtgcctgggcttcctggatatcatctcgaattttacccatttcttcatccaactgatgagcaatcttggctgtaatttccagtcgcttctttatctcctctgggaaatccccttggtacttgtagttgagagaatgttctatcgttgcccagaaattcatggccaaggtacgtatttgaatttccgccaaaatggttttagcaccattgatagtgtcaaccgtatattctactaccacatgataggaacgatagcctgatgcttttcgatgagtaatgtaatctcgctcctgtatgatccgcatatcctgacgcttgcgcaaaatctccactacttccttgacgtcatctacaaactgaaccatcacacgcaaaccagcaatatcttgcaaatcgtgctctaaggtcgcataagtaatgccacgccgagccattttttccctgatgctctcaattggcttgactcggccagtcacaaactcaatcggagaatgcctattttgcttacgatattgcttccgaataccacgtagtttaatctttaactcaccaacagcttgaatgtaaggatctagaaattcttcccattctaaggtcatatattctcccttgttctcatattatccttcaaaaatatctttgattttttctccagattcatatacaataaatacaatgcttattataccataaatccgctttcaacgataaagaaaaggtaagaaaaatgaaacatttagaaattgaattgaaaacactcttgaaaaaagatgaatacaatcgtctaaaggaccagttcacagacgtcactcctgttcttcaaaaaaattactacatagacacgcctgattttgaactgagagaaaagaaagttgctatgcgcattcgaacctttgaagactgggcagaattgacactcaaagtcccgcaaagtgttggaaatatggagtacaaccaaaaattgcgactaaaagatgctgaaaactatctgaacaaggaagaacttcctcaagggcttgtgcttgatgaattagcaaaacatggtatccaaagtaaaaaatggcaggtccttggttgtctaacaacgcttcgctatgaaatgcaaacaccaattggcctcatggcactagatgaaagtcagtactttgatattacagattacgaattagagcttgaagtggaaaatcacgagcaagggaaacaagatttccagcaatttttagaggaaaatcagattgcttatcaaaaagctccctcaaaattggtccgatttgtcaaaagcatgaaaaatagctgaaataatctctattttttggtaaaatagaaaaaataaaatacmaaaatcccagttcatataggctaggcagatatggctaggatttaaaaagtttacagaggaaggtctataatgtcagatagaaaaaacatgaaacttttcgcactcaactctaaccaagagattgcacagaaaattgcacaagctgttggtgtaccgcttggaaaactatcatcacgtcaattttcagacggagaaatccaagtaaatatcgaagaaagtgtccgtggttatgatgtgtacatcatccaatcaacaagtttccctgttaacaaccacctaatggaattgctaatcatggtcgacgcttgtgttcgtgcaagtgcccacagtatcaacgttgtccttccatattttggttatgcacgtcaagaccgcatcgcttcacctcgtgagccacttacagcgaaactagttgccaatatgctagttaaggctggtgtagatcgtatccttacgcttgatttgcatgccgttcaggttcaaggattctttgatattcctgttgacaacctcttcacagttcccttatttgcaaaacattattgcgataagggcttacttggctcagatgttgttgttgttagccctaaaaattcaggtgtaaagcgtgcccgtagcttggctgaatatcttgatgctcctatcgccattatcgattacccacaagatgatgcaactcgcaacgaaggctatatcatcggtgatgttgaaggtaagaaagctatcttaattgacgatattctgaatacaggacgtaccttctctgaagctgctaaaatcgttgaacgtgaaggggctacagaaatttatgctgtttctagccacggtctcttcgtcgaaggtgctgctgaacttcttgataatactaatattaaagaaattcttgtgactgattcagtagcaacaaaagaaaaaactcctaaaaacgtatgctacatcactgctagtgagttaattggtgatgctatcgtccgtattcacgaaagaaaaccagtcagcccactctttgcctacaacaaaaagaaataaggtgattctttgatttatttggacaatgctgcaacgactcctatgtcatcagttgctatttcagctatgactaaggttatgcaagaaacccatggcaatccttctagtatccatggtcatggtcgtcaagctggcaaacttttgcgtgaagcccgtcaggaactagctcaattactgggaacaaaacctcaacatatctttttcacttctggtggaaccgaaggcaacaatactgctatcatcggctactgccttcgtcatcaagaaaaaggaaaacatatcatcacaactgccatcgagcaccatgctgtccttgaaacaattgattacttggttcagcacttcggttttgaagtaaccattatccagccaaaaaatcaggaaatcaccgcccagcaaattcaagaggccttacgtgacgatacgattttggtttctaccatgtttgccaataatgagacaggaaacctacttcccattgctgaaattggccaaatactcaagcaacatcctgctgcctaccatgttgatgcagttcaggctatcggtaaaatccctattcacccagaagaattgggcattgattttctcactgcttcagcccataaattccatggtcctaagggaatcggttttctctacgcatcaagcatggactttgattcctatcttcatggcggagatcaagaacagaaaaaacgagcaggaactgaaaatctagcttccatcgttagcatggttgcagccctaaaagaagacctagaaaaacaagaagaacattttcaacatgtacaaaatctagaaactgcctttcttgcggagcttgagggagttcagtattacctgaacagaggagaacaccatctaccttatgtcctcaatattggatttcctgggcagaaaaatgacctcctactccttcgtctagacttagctggaatttcaatctctactggctcggcctgtactgcaggcattgtccaatccagccatgttcttgaagccatgtacggggaaaattcagaacgtttgaaagaatccgttcgcatcagtttgtctccacaaaatactatcgaagacctagaaaccctcgcaaaaaccttaaaagaaattatcggaggttagccatatggcatttgaaaaaaccattcagttaaaaaattgtcgttacgactacactcttagcccttctgttaagaaattcaccctcaaagacaacactttttttgaaacaaaagttggtaactatgaactgactcgcctacttgaaaaggttccaaacagcggtgaaggcttccaactaaaaatcatcattaacaaggaactcacaggggctaaaatcaatatcactgacaagtttggtcttcgtctagttgatattttcaaatcagaagaccaccacattcatcaggaaaaattctatttcctcatggatagcttggtagaacgtggtgtctttacaaaagcggaaagatagagccaaaatgtttgaactgacctataaggacagctatcatgtagagcgcactctcaagtatgaggattacgaggctctcatgctggctctgtcaggatgtgtgactctgccagatacactttatgtaacttctttgacctttaaagggcaggaagtttaccaaggactggtcggagacctctaccgttttctatcacatgcagattttttacatcaaaactaagatttttcttagttttttcttgtttttgttgattttttcacaatgtttctataaaatagaagaatagaaaggttgtgattttgtgaaagataaacagtctgctattccaaaagctacagcgaaaagactctctctctactatcgaatttttaagagatttcatgcagaaaagattgaacgtgccaactctaagcaaattgcagaggctatcggtattgattccgcgaccgtacgtcgtgatttttcctattttggtgaactaggtcgtcgtggttttggctatgatgtcaaaaaactgatgacattttttgccgatttgctcaatgataactccatcaccaatgtcatgctggtaggtattggaaatatgggccatgcccttctccactatcgcttccatgagcgcaacaagatgaagattatcatggcctttgacctagatgaccatcccgaagtcggtacccaaactcctgatggaattcccatttacgggatttctcaaatcaaggataaaatcaaggatgctgatgtcaagactgctatcctgaccgttcccagcgttaagtcacaagaggttgctaatctcttggtggatgctggcgtgaaaggaattctcagtttttcacctgtccatctgcatttaccaaaagacgtggtcgttcagtatgtcgatttgacaagtgaactccaaactctcctctacttcatgcgaaaagaggattagaaagcgaaaatcattttatgaaaaaaccagttattgggattacaggaaacgaaaaaactcatccagatgatgacatcatgatgagctacgcagcaaaaggctttgttgaaggcgttaaagacgctggagggattcccatcatcctaccgattggtgatcaagaaatggcctgccactatatcagtatgattgacaagctcatcttgacaggtgggcaaaatgttgatccaaaattctatggtgaaccaaaaaccattgatagcgatgactaccaccttcaaagggatatctttgaactggccctcatcaaggaagctattaaacagaaaaagccaattttctctgtctgccgtggtacccaactctttaacgttgccatgggtggaactttgtatcaagatatcgaagatcactggcaggattgttccgccgagtacacaacccaacgcttggcgacagaaccagataccgttctccgagaaatctatggagaaatttcccatatcaactccttccaccaccagagcatcaaggatttagcaccaaatttaaagattgcggctcatgatcctaaggatggcattattgaagctgtcatgagtacggatgatgtcgcctttctcggtgtccaatggcatccagaatttctttttgaaaatcgtcccaaagataaaaacctctttgactatatcgttaatgaactttagattaaatctgtcttttctcgataactaaagtaactggagtgagagacaatcaaatggtccaagaggacaattcccatcagatcgcaggcttctttgacaagtttagtgacatgatcatcatttcggctaggggccaccgctcctgaaggatgattatgaaccaagatgagagaagtcgccatatgcttgatagcatagtgaagaatctctcgcggttcagcaatactacgagtggcagaaccgataaaaatggtctgttgatggatgatttgattttgagtattgagatagagcgccaccaggtgctcttgttttttatcccccaattcctgttgcatcttcttggccaacttttgactgctgagaatactttccatctcaagggtttcgtgtttatgaatacgatggcccagttcaatcatggcttgtaactctattgccttaactcgtccgataccagatagactctgcaattcctgcagtgtcatttttttcaaatctgttaggcttgaaagattattcaagactttctgggcaatttcaaaaacactggcctgacgtgttcctgttctgagtaaaatagctagcaactcttggttactgagcgcttccactccttcttgggcaagtctttctcttggcaatagtgaatcttcttggaatgaaatactgtacataaaaatcctcctcactttattattcgtgagaaggatgaaaaattagatttttttctcaattggggccacactggccaaaagttttttcaaaccaacttctgggaaattgatttttaattcctgcgtagcaccgctacctgaaacttccagaacagttccctctccccatttcttgtggagggcaatgtcaccaatggaccaatttgtttcgctagacgctgattttgcaccagctgtaaattgaccaaatgggagaccgcttgactggatagtttttggggccgcactgcgtttacggtcttgaagagcctgggccaaactcataccttgaccgaaggcaaggccaccactactatatgatgctttaaagcttgtatttgctggacgagccagaccttgatactcaagcaagtctgaactgatttcgttaataaatcgagtaggacggttgtagttggtacgaccaaaaagcaggcgtgagttggcatttgtcagatagaggattttctctgcacgcgtaattcctacataggccagacggcgctcttcttctagttcatcttgatcttcagcagcacgactaagtggaaagacattttcttccatcccaatcaaaaagacaactggaaactcgagacctttggcagcatgcagggtcattagagtaacttctgatgtctcctgactacctgaatcggtgtccgcaatcaaggctaaatcatttaagaaacgactcagtttgtccagaccagtttcttcttctggctcatcagaggtgtcatcaaagtttttcgtcacagaaaggaactcttcaatattttcaacccgagccttactttccagagttgcttgggcattaagaatatcaacgtaacctgttttttctagaaccgcctcaaccaactctgtaatatttaattgatctagctgctctcgcaaatccagaaccatattggcaaaatcccagatagactgggctgctttacccttgataccagacaacatgatattggcagaagcatccagcatggacatgttttgcatattcgcaaagtcacgaattttctcaactgtacctgggccaattccacgtttaggctcgttgataatacgctcaaaactgatattgtcactcaaattagcaatgaggttgagataagcgataatatctcggatttccttacggctgtagaacttggttccgccaaccatggtataagggatatttgacttgagcaaggcttcctcaatagtacgggactgggcattagtccgatagagaactgcaaaatccttgtgaaggaagttttgactgcgactaagttcatcgatggttctggctacaaatacagcctcatccagctcatcatcagcacgatagtaaacgatttgctccccatcagcattctgggtccagagattcttaggacggcggtttttattgtttttaatgacctcgttggccgcttggagaatagttttagttgaacggtaattctcctccagcaaaacaaccttggcttggggataatctttctcgaaatccaaaatattctgcatatcagcaccacgccaaccgtagatagactggtccgcatccccaaccacacagatatttttaaaacgggaagccaagagtttgaccaattgatactgagcgtggttggtatcttggtactcatcaacatggatgtactgaaacttctgctggtagtaggtcaaaacatcaggattttgatcaaagagacgcaaggtcagcataatcaaatcatcaaaatcaacggattcagactgacgaagttctttttgataagctgtgtaacactgggctacgatttgcgtgtacatatcgccagcttgggcagcataggcaacatcatcaatcagatcattcttagcattggaaattgttcctaagatgctccgttcattccattttttcggatccaggttcaactgcttaagaatgcgtttcataagagttcgctgttcaccaggatcgacaattgtaaaattacggttgtagccaatatggtccgcatcgcgacgcaagatacgaacacacatggagtgaaaggtcgcaatcaaacagtcctgagtggctggattgaggccataagcacgttccttcatctcacgcgcagccttattagtaaaggtaatggccaagatattccaaggattgaccagcttttcatcaatcagataagcaatgcggtgggtcaaaactcgggtctttccagaaccagcccccgccatgatcaacaagggaccttctgtcgtttgcaccgcctcagcctgacggtcattcattccatttaataatgcgttcatcttctcttccttactcttgaagtcaatatttccattatatcagaattcgaggaaaatatctttaactagaatggttacgtatagtaaacaactctctcatcaactgaagacaactacttctatctagataaaaaatgagcttggattaaaatctccaaactcatttaaagtcaattacaatctactagaacaagcctagaacagttccgtcgctttcaacatccatgttgagagctgctggtcgttttggaaggcctggcatggtcatgacatcaccagttaaagcaacgatgaagcctgcacctaattttggtaccaattcacgaatggtaatttcaaagttttcaggtgctccaagtgcatttggattgtctgagaaactgtattgagttttagccatacagattggcaatttgtcccaaccattctgaacgatttgagcaatttgcgtttgggctttcttctcaaagttgactttgctaccacggtagatttcagtaacaattttttcaatcttttcttgaacagaaaggtcattgtcatataaacgtttgtaattagctggggtttcagcaattgtcttaacaactgtctcagcaagtgctaccccaccttctgcgccatcagcccagacactagccaactcaactggtacgtcgattgaagcacagagttctttcaaggctgcaatttcagcttcagtatcagatacaaattcgttaatagctacgactgcaggtactccaaatttacggatattttcaacgtggcgttgcaagttagcaaaacctgcacgaactgcttctacattttcttcagtaagagcgtctttagccacaccaccattcatcttaagggcacgaagggttgcaacaataactactgcatctggagatgttggcaagtttggtgtcttaatatcaaggaatttctcagcaccaaggtcggcaccaaaaccagcttcagtaaccgtgtaatcagctaagtgaagagctgttgtcgttgccaaaacagagttacatccgtgagcgatattggcaaatggaccaccgtgtacaaaggcaggtgttccgtaaattgtctgaaccagattcggcttaatagcatccttcaaaatcaatgccaaagcaccttcaacctgtaaatcgccaacagaaacaggtgttcggtcatagcgataaccgataacaatattagccaaacggcgtttcaagtcctcgatatccgttgccaaacaaagaattgccatgatctctgaagcaactgtaatgtcaaagccatcctcacgtggaataccatttagaggaccaccaagtccaacggtcacatgacgaagagctcggtcgtttaagtccacaacacgtttccagaggatacgacgttggtcaattccaagctcattcccttggtgcaagtgattgtcaatcaaggcagaaagcgcattgttggcagttgtaatagcatgcatgtccccagtaaagtggaggttgatgtcttccattggcagaacttgagcgtaaccaccgcctgcagcaccacccttaatccccattactggaccaagggatggttcgcggatggcaatcatagttttcttgccaatcttgttcaaagcatcagcaagaccaatggtaatagttgattttccttcacctgctggtgttgggttgatggcagtaaccaagatcaatttcccaactggattgctctcaactgcacggattttatcaaagctgagcttagccttatactttccgtacaactccaaatcgtcgtaagaaataccaagtttctctacaacatcaacgattggcttcaactcaatactttgtgcgatttcaatatctgttttcattcaaaactcctctaacctcttatatgataattcattataacacaaaacaagatttttaacatccttaaactctctaaacgttcgtaaatatctctatttttaagaattttagagccctttcttaaattttatatggctttatagtttgaaactatagtaaatcttcgtttttaccaaaaatttatcacttttattttacttaccgtttatttttgtgtacaatagtgctatgaaaattttagttacatcgggcggtaccagtgaggctatcgatagcgtccgctctatcactaaccattctacaggtcgcttggggaaaatcatcactgaaaccctgcttgctgcaggacatgaagtttgtttgataacgacaaaacgagctgtgaagccagtagcccatcctaatctaagtattcgagaaattaacaataccaaggatcttcttcttgaaatgaaagaacgtattcaggattatcaggtcttgattcactcaatggccgtatctgattacactcctgtttatatggcaggacttgaggaagttcaggctagctccaatctagaagaatttttaagcaggcagaatcatcaagctaagatttcttcaactgatgaggttcaggttttattcctgaaaaaaacacccaaaatcatctctctagtcaagaaatggaatcctgctattcatctgattggtttcaaactgctggttgatgtctctgaggattatctcatcgagattgccagaaaaagtcttatcaagaaccaagctgacttaatcattgcgaatgacctgactcaaatctcaccaaaccagcatcgtgcaatctttgttgaaaaagatcagcttcaaacagtccagactaaagaagaaattgcagaactcctccttgaaaaaattcaagcctatcattcatagaaaggaaagctatggcaaacattctcttggctgtaacgggctcaatcgcctcttacaagtcggcagatttagtcagttctctaaaaaaacaaggtcatcaagtcactgtcttaatgacccaggctgctacagagtttatccaacctttgacactacaggtactctcacggaattccgtccacttggatgccatgaaggaaccctatcctgatcaagtcaatcatatcgaacttggaaaaaaagcagatttattcatcgtagcccctgcaactgctaacactattgcaaaactagcccttggctttgcggacaatatggtgacctgtacagctctagccctgccaagtcatattcccaaactaatagctcctgctatgaatacaaaaatgtatgaccatccagcaactcaggctaatctgaaaacattagaagcctacggctatcagctgattgctcctaaggaatccctactagcttgtggagaccacggacgaggagctttagccgacctcacaattattttagaaagaataaaggaaactctcgatgaaaaaacgctctaatattgcacccattgctatcttttttgcaaccatgctcgtgatacactttctgagctcacttatctttaacctttttccatttccaatcaaaccgactatcgttcatattcctgtcattattgccagcattatctacggtccacgagttggggttacacttggatttttgatggggctgcttagcttaacggttaacacgattacaattctaccgacaagttacctcttctccccatttgtaccaaacggaaacatctactcagctatcattgccatcgtcccacgtattttgattggtttgactccgtatctagtttataaactgatgaaaaataaaactggtctgattctagctggtgccctcggttcacttaccaacactgtctttgtacttggtggaattttctacctttttggaaatgtctttgatggtaatatccaaaaactcctagcaaccgttatctcaacaaactccattgccgaattagttatttccgcggttctgaccctagctattgttccaagactacaaactttgaagaaataaaaacaatctccgctttcatacttgaaggtggagattttgtttgaagtcgtttctttttagtgaaatctttaccaacttttaactaaaaaacgaccaataaacccaagtaaatccttgctttattgtcttgtttgttgtactatactagtgtatatacagttaaaaaggagattcttatgaatacacggaaaaagacacaatttatgacaatgactgccctcttaacggctattgcaattttgattccgattgtgatgcctttcaagattgtcattccacctgcttcttacactttggggagccacatcgctatttttattgccatgttcttgtcgcccttgatggcagtttttgtcatcctagcctctagttttggattcttgatggctggctatcccatggttatcgtttttcgagctttttcccatatcttttttggtactctaggagctctttacttacaaaaattccccgatactcttgataaaccaaaatcttcctggattttcaactttgttttagctatcattcatgcccttgctgaagtattagcctgtgtcgttttttacgccacttccggtaccaatgtagaaaatatgttttatgttctatttgtactagttggatttggcacaattatccatagtatggtagactatacattggcactagctgtctataaagtgcttcgaaaacgccgttaaaaggaagaactatgacaaaagatcgcaaacaagcccttctccaactcttgaaagaagctcctaaagccctcaatggccaaagtttagctgaacattttcatgttacacgccaggtcattgtacaggacattgcaattttaagagccgatggcgctcctatcctatccactaatcgtggctacatctataagcaaattgaaaccaatccttatgttcacaaacttttcaaagtgaaacatgaagttgaagaaatcggtcaagaactccttgctatcgttgataatggtggacgtgttcaaaataccttgattgaccatcccgtttatggagaaatcgaaaccttgctgaaactgtcttgtcgcagagatgtgcaacattttctagaacaagtcgagcattcagattttagacctctgtctgaattgacagatggcatccattaccacctagtcgaagctgaaacacagcaagacctccgctatatcgaggaggccttggatcagctaggttatttagtaaaagactagaagattttcttctcccagccatcttctatacgatgacggtagaaaaattcagatttgtccggagcttccatcatctccatcaaaggtagcatatcataggccagatccaagtttggaatctggtctttttgaatccaatagctcaaatagtaacaatgatatttaaaaaccacattgaatgaaaattaacaactacttgcttactaaaaatatatcaccagttatgttgatcaacattatccttagtcacaagataaattggagaaactgtttctttttccagttttttcccttgataatgatctattgctgattgaatagcaatttcacccatcttagctggttgctgagcaatagtggcagtaatatcaccttttgcaatagcatcatgtgcatctggttgaccatcaataccaacaattaatacattgctaagaccagctgcttttactgcttgtgcagctcctaacgccatctcatcattctgtgcaaagattgcttgcacttctttgtttccttgaatcatattttgcgctgtattcaaagcttttgcgcggtcaaaattagcggattgactagaaagaacatctaaatttgtctttgaaatttgttcaaatcctttacctctatctacagttgcagaagcgccagggactcctgataattcaaaagtttttgctttttctcccaattgcttggtaataaattctgcagccattttacctgcttctacgttatcagaagcaacagttgtcaagacttcacctccattactaccgcggtcaattaagattaccggaatatttgcattattagcagctttaatagatgtaacaattgcatcagaatcaactggattaattagtaaagcatcaacattttgactaataaaattttgaatatcatctgcttgtctagcagcatcatcttgtgcatctgctatcttcaaagttacttctttttctcttgcggctttttcaagaccatctttcatagctacaaaatagggattgttagtagtcgaaatagaaactcctaattttaattcttttgccgacttttgaatcgtagatttattatcatttgatgaatttcctaaaccagtttttccacaagctactaaagcaaaaataaatgttacaaacaaagcaaaaatgctaatttttttaatatttttcatgttattactcctcgtaatatatatctatagggatagtttcaatcccgattattgtacgtcatctaataaattgttactatttccaaaaaaattgaaaattattctactgttttacaactttaaaacgatcaatcagaacagcaattaagattacaactccttttactacttgttgccaaaatgctgaaacaccgataatattaagtccattattcaaaaccccaataattaaagcacctattaaggtccccagtatgcgacctttacctcctgataaagaggttcccccaagaacaacagctgcaatagcatccatttcataactagcacctgctgttggttgagcagaacttaagcgtgatgttataatcaatccagaaattgaagccataatacctgaaattgaataaatgataattttcactttatttagtttcacacctgatatatatgctgctttttcattcccccctatagcatacacagatttaccaaatgctgttttatgaagtaaaacatataaaacaataaatacaataaacataataattacaggaaatggaattccgactatataaccttgccccaaaaattgaaataagaatgtatcacttaatccttttgtgataggattcccatttgtataaacaagtgttgcgcctctaaaaatagtcatagttgctaaagtaacgataaatggagctaatttcccgtaggaaatcaataaaccattcatcatccccagaatgcaacccaaaaattaaagagatgagaattgctaacgtaacaggcattccagatcctaataggccagcggttagcgcactggataaggctaaaattgatccaactgataaatcaattccacctgttagaataacaaaggtcattccaaaagcgatcagtgcatttgatgttacttgcaatagtaaatttaacagattatttgctgttaaaaaatttgaattgataatagtgatgacagccattaaaattatcaatgctattactgttgtcaattctgacatatacttcatagtatttttcacactattgtcctcctgtggctagttgcataactttttcttgtgtagcttcttgacgtgttaattctccactaattcttccttcatgcatgaccataatgcgatcactgactccgatcacttctggtaaatctgaagataccataataatcggcacacctcgttcagccaattcattcattaattggtaaatttcacgcttagcaccaacatctaccccacgagttggctcatctagaatcagtacttttggagcaatacctatccattttgctaaaactactttctgttgattaccaccagaaagtgtcccaacttccttatctggataacctgatttaattcgtagcctatcaattaaacgttgtacaaatatatcacttgttttattatcaaaaatgccatttttaacaaaatcacgagtactaggtaaagtcatattatctttaatagaaaaatctaaaatcaatccctcatctttacgatcttctgttaagaaaccaattccatgcttaattgcttcaaaaggatttttaattatcagttcttcttcatttattataatttgaccagattttaaagaatcaattccaaaaattgctctcattatttcagtacgaccagcacccatcaaaccagaaaaaccaagaatttccccttgacgtacatagaaagaaatatccgtaaaagcatcaccagaaagattcttagcttgaaaaacaatattcccaatctcagcctttttttctggataataatcttctaattcacgccccaccatcttttgaactaattcatccgcattagttaacttcgttctcttggtatcaattacaaacccatccctcataacagttataagatctgtaatcttaaagatttcttccatccgatgtgaaatatacacaatacctacaccatcagattttaatccttctatcactttaaaaagtgtttcagtttcacgatcagttaaagctgctgtgggttcatccataattaacaaggaaacttctgataataaacattttgctatttctatcatttgttgttgtccgactgataattgaccaatgattgcatcgagaggaatagagatattaagacgtttaaatgcttctttagctttcctttccatactagctttatctagaaacccaatcgaatttttaatttctcttcctaaaaaaagattatcaagtacagtcatatctggccaagtattcatttcttgatgaataaaactcagtccaaaccgttctgcctcttgaggattagaaaatgttttttcttttccatcaataaaaatagttcctgaagtagctggaaaaagtccagttaaaatattcattaaggttgatttgcctgcaccattctctcccattaaagcatgaacttctcctgaattaagaaccaaatcaatactttctaaaacacgattattcccaaaagattttgaaatgttcttcatttcaattttcataggcaactcccttctaaataataactcctgattgcaagattatattcgaatatggtgtatcttccccagtgcgaataactgccttaactgtagtattcatagctttcaattcttcatgactaatatattcaataattatattcgatcctaaaagatctagaactgcttgccactgttctttgtttttttccttaatttcttctgctaagaaaattttttcaataagtacatgatctgaatattcttttaaaacttctaaaaaacttggactaccttttcttaatgctaaatcaattttatcaataccttttggaactggcaatcctaaatctccaatacaaaccaaatccatatgacctaaatcatcagctagttttgctatattactatttaaaatcccatatttcttcatatcctggatgctcctttatttctttcaaactcggcatgccaccttgcgctccaaatctttgaacagaaagatgtgaagcaatcgttgcaaaggacaatgcaacattcatctcttttccttttgagacagcataagcaaaagcaccattaaacgtatctcctgctcctgtagtatcaactacttctgcttttatagcaggaatcttctgaactgctgccccatcataataaatagaaccttcaactcctaatgtcacaatcattttattaggataaattttaataatttcttctaatttcttatctggaaaaagctctgaacattcatgctcattaggagtaataaaatcacaaaaaggaatcatctctatatctgtttctctagctggtgcaggattgtaaagtaccttaactttattttcttgacaaaatttagctatagataggttggcttcatgtggtatttcattctgtaatacaacaatacttgcatcactaatcaattcccactcatttttccaatcatttgttttaactaaattattcgctccgggataataaataattctattatcacctccatataaagtaatttgtgcaactcctgtagattgtggtaccgttcccacatgttctgtagaaatattattattttgcagattacttagtaaatctgctgaaaaaatatcttctccgacgtttccaaatatgtaaatattatcttctacactggataatctaccaatagctacagcttgatttgcaccttttccacccggaactatattaaatgaatccccaaaaatcgtttcacctccttctggaatcctttttgttctcataactaagtccattgaaatacttccaacaacaacaattttactcattactttctccttaatgtatttctttctacgtatctaacaggtagtttaattttagcttcatctatagagaacttatttgccatattatagattagctttgcagcctgttctcccattttatatgatgattggtgaatagttgataaagaaggataaataaattgactaagtacaatatcatcataaccaatgatttgaatatcatctgggatttttttaccaattgctaaaatttcatgaatataagctatcgcatgaatatcagaaggcgctataatactatcaatatttggatttctttttagattctctttagcttctgtttgaattttttcaaactcaaatgtttcactttcttcaatacgaatctctaaagatttattcctcaaatagtttaaacttgcttcaaatcgttccgcaatgttctcagctttatcatctaaaactttaataatcataacttgcttagcgccagcattccaaattgctttagcagccaaacgtccacccaactgattatcagaaaagacaccgtaacctgtatctttactaatccggtcaaccacaacgacaggtaacgtcagatttggaaattcctttgtaaagtcaagtgtcgttataataccagctgcatttgtttttaacaaaaggtttatatattcttctaacgaatcatgatctgaaatagtaccaaccataatcctataacctttatctttcaaatatgattcagctcctcgaaccaatcttgggaagaagggattagaaatatctggcaataagagtcctaccatttgattttttttagttttcaaagattgtgctaatacattcggcgtgtaatttaatttcttgatagcattttttatcttttctctagcatcatctccgacatagccttttttcgaaatatatcttgaaactgttgattttgatactccagcttcttcagcaacctgttttattgtagtcatcactcctccttcttacgttgtggaaccgttcccttatttatatagtaagcgttttcttttattttgtcaatacttttttagaaatattttaaatttatttcagagtacacatgtttttactaatatcctattactattagatacgaaacacaacaagacctccactatattgaggaggccttggatcagctaggttatttagtaaaagactagaagattttcttctcccaatcatcttctgtacggcgagggtagaaaaactctgatttgtcaggagcttccatcatctccatcaagggtaacatatcataggccagatccaagtttggaatctggtctttttgcacccaagaaacttctccttcatctgaagagcgaaggctaccagagaactcagtcgccttataacaaatgacaatatagcgcccacctgtatctagtggccaatttttaatgccgacaagttgaggattttggatagtcaatcctgtttcttcgtagatttcacgaatgacagactccgcaaaagcctcaccattttcaacatgacctccaggaaaggcataaccagaccagcgatttgtttcaggagagcgatactgcataaccacgcgctgagtttcggggtcttcaatcagacaaatgtttgttaaaattgttaattgggaacgggacatattttctcctttagatactattctaatccaacgccttgacttccagcatcatatcacgaatctgagctgcgagttcaaagtcaagcacttcgacagcttcttgcatttgtttttctagtttcttgacgaggtctttgcgttcttgtttattaaggctattaatatcgacttccttgtcctcttccttagcaactgccttggtcacggcaataagatcacggatttctttcttgatggtttgaggtacgataccatgctcttcattataagccatctggattttccgacggcgggcagtttcatcaatggcacgttgcatagactgagtcatcgtgtccgcatacatgatgacatgtccttcgctgttacgggcagcacgtccaatagtttggattaagccacgttcgttacggaggaagccttccttgtcagcatctagaatggctacgagactcacttcaggtacgtcaatcccttcacggagcaggttaattccgaccaagacatcaaagacacccaagcgcagatcacggataatctccgtccgttccaaggtcttgatatccgagtgcatgtacttgaccttgatacccatttccttgaagtagtcggtcaagtcctctgccattttcttagtcaaagtggtgataaaggttcgttcattcttttcaacacgggcattgatttcacccaaaaggtcatcaatctgtcccatagtcggacggacttctacctctggatccaagagtcctgttggacgaatgatttgctcaatcactgtctcggtctgttcattttcatagtcaccaggtgtcgctgaaacgtaaacaatctgatgaacgtgactctcaaactcctcccgacggagaggacgattgtccaaagctgatggcaaacggaaaccataattaaccagcatttccttacgcgaacggtcaccattgtacatacctttgatttgtcccatagtcatatgactctcgtcaatcataatcaagaaatcatctggaaagaagtcgagaagcgtataaggtggctcaccttcgctacggccatccatatggcgtgaatagttttcaaccccatttgtatagcccatctcgcgcagcatttcgatatcgtactctgtccgctgcttcaaacgctgagcttcaagtaatttgccttccttctcaaagacagctaactgctcctccaactctgcctgaatcttggcaatagccacttccatatggtcgtcattggtcacaaagtgagtagctgggaaaatcgccaaatgatccacttctcccaatacctggcctgtcagagcctcaacctcacggatacggtcaatctcgtctccgaaaaactccactcgaaaggcatgttcatcacgggaagcagggaaaatctccactacatccccacgcacacgaaatcttccccgttggaaatcaatatcattacgttcaaactggatatcaaccaagtcattcaagagtttatcacgagaaatttcaagacctggacggagactaacgacactatcagcgtattccttgggcgaacccaaaccatagatacaagagacagaagccacaacaatgacatcattacgctccaaaagagccgaagtcgctgagtggcggagtttatcaatctcgtcattgacagagctgtccttctcaatataggtatcactagaaggaacataggcctctggctggtaataatcatagtaagacacaaaatactcaacagcattctcagggaaaaattccttaaactccccatagagctgtcctgccagagtcttattgtgggcgatgaccagagtgggtttattgactttggaaatgacctgactcatggtataggtcttccctgtaccagtcgcccccatcagaatctgagctttttcgcccccctcgatattatcaaccaactgctcgatagcttggggttggtctcctgatggttcatattttgatactagtttaaattgattgtcagtaatgcgggtaatcataagaatcctctcttgatgtgctattcctattttagcatacttgtaacattttcacgaagaaaaggacggaccgaagtcacatcctttcattttctttctttaattgataagcgagatagacaatcagcagtagcaagatcagacttgtcatgatagatccttctatcccaaaagagccacctgatagccaatcttgattaccttgtggtaaaaaggtcatcaaagacgttcctgacggctgaccactaactaaaatcccaaaaagatttccctgagcaaaattccaagccccatgaatacctgctacaccccaaactgtatctgttttgaggaggtaaagtgacatggcaactccgaataaaaagagattcactagagatagaggggtgagaccagaatttcccgcatgaagcagggtaaagaacaggctagatataagaacagctagttttagattggttcttgaggccaattgaggaaggagccaagcacgggccaccacttcttctgttgtcccctgtaaaatccaaaatggaacggtaaaaatgacaaaggctagcgaataaggattcaagtgaatggactcaaaacgatattgccctaatgctactaaacctaacaaggtcagaagaaaaagtgccagacctataccaaatcctttaagaagattgctgaagaaattctctctataaaatcccaaggttcgaataggtcttttctcaacttttctagtccatctgaacacagtgttgagaacgaaaccaaaggacagcaattctaaaattaaacgaaagtcacttgttttatccgtcaagctctgaagcaaggtttgtaagaaggcagcaaaagcttgaccactctctccaaaatttctagcaagtccgatgagtgctaacaaactaataccatacaaagtataagccacaaactctcctacgaagacaaaaacaaaggctaacaagagacttgtgtaaatgtataaactcatttttgaagcttggaagtctttaaatatttttttgttcttcatatccctgtcctctttccttctattatatactattattatagcactttgtggtagcagttcaagaaagaaataaagagcttttatgttatatcttctaacataaaagtccctagatttgcatttttttgttttttctgatataatgggaaaatattcggaaaaggagactaaaaatgaagaaaaaatttctagcatttttgctaattttattcccaattttctcattaggtatcgcgaaagctgaaacgattaagattgtgtctgataccgcctatgcaccttttgagtttaaagattcagatcaaacttataaaggaattgatgttgacattatcaacaaagtcgctgagattaaaggatggaacattcagatgtcttatcctggttttgacgcagcggtaaatgcggttcaagctggtcaagctgacgctatcatggcagggatgacaaagactaaagaacgtgaaaaagtcttcaccatgtctgatacttactatgatacaaaagttgtcattgctactacaaaggcacacaaggattagtaaatatgaccaattaactggcaaaaccgttggtgttaaaaacggaactgctgctcaacgttttcttgaaacaatcaaagataaatacggctttactattaaaacatttgacactagtgatttgatgaacaacagcttgagtgctggtgccatcgatgccatgatggatgacaaacctgttatcgaatatgccattaaccaagggcaagacctccatattgaaatggatggtgaagctgtaggtagctttgctttcggtgttaaaaaaggtagcaaatacgagcacctagttactgaatttaaccaagccttggctgaaatgaaaaaagatggtagtcttgataaaatcatcaagaaatggactgcttcatcatcttcagcagtgccaactacaactactctagcaggcttaaaagccattcctgttaaagctaaatatatcattgccagcgattcttcttttgcaccttttgttttccaaaactcaagtaaccaatttactggtattgatatggaattgattaaggcaatcgctaaagaccaaggttttgaaattgaaatcaccaaccctggtttcgatgccgctatcagtgctgttcaagctggtcaagccgatggtatcattgctggtatgtctgtcacagatgctcgtaaggcaacttttgacttctcagaatcatactacactgctaatactatccttggtgtcaaagaatcaagcaccattgcttcctatgaagacttgaaagggaagacagttggtgttaaaaacggaactgcttctcaaaccttcctaacagaaaatcaaagcaaatacggttacaaaattaaaacctttgctgatggttcttcaatgtatgacagtttaaatactggagccatcgatgctgttatggatgatgagcctgtcctcaaatattctatcagccaaggacaaaaaattgaaaactccaatcgctggaactccaatcggtgaaacagcctttgctgttaaaaaaggagcaaatccacgaattgattgaaatgttcaataacggacttgcaaaccttaaagcaaacggtgaattccaaaagattcttgataaatacctagctagtgaatcatcaactgcttcaacaagcactgttgacgaaacaactatctggggcttgcttcaaaacaactacaaacaactccttagtggtcttggtatcactcttgctctagctcttatctcgtttgctattgccattgtcatcgggattatcttcggtatgtttagcgttagcccctacaaatctcttcgtgtgatctctgagattttcgttgacgttattcgtggtattccattgatgattcttgcagccttcatcttctggggaattccaaacttcatcgagtctatcacaggccaacaaagcccaattaacgactttgtagctggtactattgccctatcgctcaatgcagcggcttatatcgctgaaatcgttcgtggtggtattcaggccgttccagttggccaaatggaagccagccgaagcttgggtatctcttatggaaaaaccatgcgtaagattatcttgccacaagcaactaaattgatgttgccaaactttgttaaccaattcgttatcgctcttaaagatacaacaatcgtatctgctatcggtttggttgaactcttccaaactggtaagattatcattgcccgtaactaccaaagtttcaagatgtatgcaatccttgctatcttctatcttgtaattatcacacttttgactagactagcgaaacgcttagaaaagaggattcgttaatggcaaaactaaaaattgatgtaaatgatttacacaagcactatggaaaaaatgaagttttaaaaggaattacgactaaattctatgaaggagatgttgtttgtatcattggtccttcaggttctggtaaatcgaccttccttcgtagcctcaaccttctagaagaagttactagcggtcacatcactgtgaacggttatgacttaactgaaaaaacaaccaacgttgaccacgtccgtgaaaatatcggaatggttttccaacacttcaacctcttcccacacatgtctgtattggataacattacttttgctcctatcgagcacaagttgatgactaaggaagaagctgagaaattgggaatggagttgcttgacaaggttgggctagcagataaagctaatgctaatccagatagcctatcaggtggtcaaaaacaacgtgtggccatcgctcgtggacttgcaatgaacccagatatcatgctctttgatgaaccaacttcagcccttgaccctgagatggtcggagacgtactgaacgttatgaaggaattggctgagcaaggtatgaccatgattatcgtaacccatgaaatgggatttgcccgtcaagttgccaaccgcgttatctttactgcagacggtgaattcctagaagacggaacacctgatcaaatctttgataacccacaacacccacgtctgaaagagttcttggacaaggtcttaaacgtctaaactcaaactgtaaggatttccttacagtttttttctatctcgtattggattttttgatttttcggaaaattatgttagaattaagtttatgaaatgaggtttcctcatacctagcaagactaggaataaaaatagaaattaggtagctagatgtcatctaaggttattgttacaattttcggtgcgagtggagacctggctaaacgcaagctctacccttccctttttagactttataaatccggcaatctttccgagcactttgcagtcattggaactgctcgtcgttcttggagcaaggaatattttgaatctgttgtagtcgaatcgatccttgatttggcagatagtaccgaacaggctcaggagttcgctagccacttctactatcaaagtcatgatgtcaatgatacagagcactacattgctttgcgtcaattgcaggctgaactaaatgacaaataccaagctgaacacaacaagctcttcttcttgtctatggcacctcagttctttggaactatcgccaaacacctcaagtctgaaaacattgtggatggtaaaggttttgagcgcttaatcgttgaaaaaccatttggtacagattacgcaactgcaagcaagttgaatgacgagctcctagcaacatttgacgaagaacaaattttccgtattgaccattatcttggtaaggaaatgatccaaagtatctttgcagttcgctttgcaaacttgatttttgaaaatgtttggaacaaggattttatcgacaatgttcaaattacttttgcagagcgcttgggtgtagaagaacgtggtggctactatgaccaatctggtgccctccgcgacatggtacaaaaccatacactacaactgctttctctccttgccatggacaagccagcaagcttcacaaaagacgagattcgtgctgagaagattaaggtctttaaaaacctctatcacccaactgatgaagaacttaaagaatactttatccgtggtcaataccgctctggtaagattgatggcatgaaatatatctcttatcgtagtgaaccaaatgtgaatccagaatctacaactgaaacctttgcatctggtgccttctttgtaaacagcgatcgattccgtggcgttcctttcttcttccgtactggtaaacgtctgactgaaaaaggaactcatgtcaacatcgtctttaaacaaatggattctatctttggagaaccacttgctccaaacattttgaccatctatatccaaccaacagaaggcttctctcttagcctaaatgggaagcaagtaggagaagaatttaacttggctcctaactcacttgattaccgtacagatgcgactgcaactggtgcttccccagaaccatacgagaaattaatctatgatgtcttaaataacaactcaactaactttagccactgggatgaggttggtgcatcatggaaattgattgaccgtatcgaagaactctgggctgaaaatggtgccccacttcatgactataaagctggaagcatgggacctcaagcaagctttgacttacttgaaaaattcggtgctaaatggacttggcaaccagatatcgcttatcgtcaagatggtcgtttagaataaaaaaaatcctgcaagtttgtgccttgcaggatttttgcttctgattagattaagccttctaagagacccttcataaagttttctgagttaaactctccaatatcatcgattttttcaccaaaaccaatcaattttacaggaatattgagttcttcacggatggctaaaacaacaccacctcgagcagttccatcaatcttagtcaagacaattccagttaatggcgttatttttgaaaattctttggcctgtacaagagcgttttgacctgttgatgcatcaagtgccaagaaggtttcatgcggagcttctggcacaacacgtttgatgatacgaccaatcttttctagctcggccataaggttatccttattttgcagacgacctgcagtatcgatcatgagaatatcgataccttcagatacggcacgttccatgccatcaaagaccacactggctgggtcagctttttcagctccagttactactggaacatctacacgacggccccattctgctagctgggctactgcccctgcacggaaggtatctgccgcaaccaacatgactttcttgccagcttgtttgtagcggtgggctagtttcccgatagaagttgttttcccaacaccattgaccccgacaaagagcatgactgtcaagccatcttggaagtggattctttcatcgtagttaccatccttttcataaagctcaaccaatttctcaatgatgacacggcgaagtgcgtcaggtttcttggcgttttcaagcttggcttcgtagcgtagctcctctgttaagttagaagcgacctggacaccaacatcactcataattagcagttcttccagttcctcgaaaaattcttcatcaacagagcggaaattggcaaagaaggcattcaaacgagcaccaaatcctgtacgagttttcttgagactgcggtcatatttttcctgaacagtctcttctacttgagtcgtttctgcttcaagaacttcagaattattttcttctacagtctctaggagctccgtattctcttcctctgtgacttcttctgagtttggaaattcttctatttcttcttgagaaacttctacagttggttctgaatccagactttcttcaactgtgtcttgattttcctcttcttggagcagagcttcttcagaactttcaacttctgcttcttcatgaggaagttcctcagcttctgttaaggctggctcaacatcttcagacaaatcaagattttccagagcttcttttacaacttcttcgattttaggttcttctttttttccgaatagacggtcaaacaatcccatatcttagttctcctttagcacatattcttcgatagcccaggcgacagcttcctcatcattggtcattggggtcaccacatttgcgactgccttgacttcaggaacagcgttttgcatggcaacaccgagccctgcccattcaatcatagaaaggtcattggcttcatcaccacaggccatcacttggctttggtcaattccaagatgactgattagtttagccaaaccggttgctttgtgtacattctttggtgaccactctagcaacatttcacgtgatttaaagatttcatattggtcaaacaattctggtgaaatcttttgaatggctgcatccaagggttcttgagcaaaggcagtcacgcatttattgtaggtcatttgactagacaggtcttcaaagtcaactggtacaaaagttaaagctggattgaatttggcataaagactttcttggtccgattggatttgataaacagttccttctgagatggcgtcaagaggcagtgacaatttctctgtttcttcatacaagcgtgccacatcatcatatgaaaagactgttttatcaaggatttcacctgtatttttctgaaccaaaccaccattaaaggtaatggtatactcatcttcatgaccgtcagtccccaactcatggagaaagaaatccatagcttttaagggacgaccagttgtcaatacaactttaataccacgatcacgcgcagctttcaaggttgccttggtacgatccgtcagctttttatcagtagtcagcaaggtcccgtccaagtccaatgcaatcaattttatatctgccattataagccctccatataagctataaccgactggtctttatggtgaccaatcacagtctctgctaattctaaaatttctggtcgtgcattttcaggagctacaggatgtcccacaacctgcatcatgtgcaagtcatttagattgtctccaaaagccatgacctgatccatcgtgatgctaagttttttagctaattcaacaatggctactcccttatcgacatagtccagaacaatatcaatggattcaaagccagttgtcatggccttaacaccaggaacgttttcgtttacccaagcttcaccagcttcaagggtttcttctgtgaagttggttgtaaatttgaaaatatcatctgtgatatcttctaaactcgctactttttggatattttcattataatgttggctctctttcaaataggtctcatcaaccgtatctagcacataagagcccttcttacccgtcaagagcaatttattgatatctacataaggtgacgttttcagcctttcaaaagttgatagataaaactcacgagacatggtcgcttcatacaagtcttgacctcgatactctaccaaactgccattttccgcgatgaaaatgatgtcatcacgaacatcagcaaataatttttctagagataaaaatccgcgccccgaagctaccgcaaagtaaatcccttttttcttgtaggaaaccaagagagacttgaggcggtccatatcaaagcgtccattcccatctaggaaggttccgtccatatccgttgctactagtttaattgtcatccttcaatactttctaaatcttttaacttcaccgaaacaatttttgagacacctgattcttgcatggtcactccatagatagaatcagccgctgccatggttcctttacggtgggttacgacgatgaactggctgtccttgtcaaagcggttgaggtaatccccgaaacgtttaacattggcttcgtcaagcgcagcctctacctcatccaaaatcacaaatggaatagtcttaactctaataatagagaaaagcaaggctagagctgatagggctttttccccaccactcatgaggttgagggactggattttcttgcctggtggttgaacagaaatctcaaccccagctgtcagcaagtctccttcagtcaaaatcaggtctgcttgacccccaccaaacatctgcttgaaagttactttaaaggactcacgaatagcttcaaaggttgatttaaagcgttccttgacctcatcattcatctctgtaatggtttcaagcagcaagtttttcgccgacaaaatgtcatctcgctggctatttaggaaatccagacgattgtgaacttcttcgtactggtcaatagcttccaagttgaccggacccagtgaacgaatagccttctctaaatccttaacttcctcctctgccagattgagattttcaagttcatgagccttttctagtgcttcagtatagctaatctgatactgatctgttaattggctttgtaaatggcgtaagcgctcgctaaccttttctttcttagcttcagcacgtgtttgcttgcgaatccactcctcattatgttggcgagcttggtccaaatgactagcaatatcatccagtttaccttcaatatcatccaactcaaactgcttgcgaatcaaaccttgttggagatttgttttctggtttttggcttcttcagcctgttgactgagcaattctgtatcaaccttctccagattatcaaccttttcttgaagaaggcgctggatttcctcttgttcgatatctagattattcaattccttgcctagacggtcaatatcagccacttcataacgtttttgcccttgcagttctgtcttaagcaagcgaacttgcgctacctgttcttgcaagttttgatagcgttcttggatggcatttttgttagacttaatctcttcaatctcagcttccagattttgcttgtcactggcgattgtagtaaggcgctcttggcatttttccttatccgcttgccaatctccctcagaaagacgatttaattcctcttcttggagtttccaaagagtttccagttcatcaacttgctgactggtctgctggtaagagagggataagccctgctcctgaatacgtgcctgttctccctgagatttaatagcttctaatctttctgtcaatctagccatctggtcttgcaaggtcttcaaagccacttcttctgaacgaagacttgcttcctcttcagcaatttctttttgtaattgctccagttctggcttgataaaaatactgttgttctggcgattggctccacctgcataggaaccacctgtgcgcagctctgtcccatccagtgtcaccatgcgaacctgataacgaacgtgacgagctgctgcacgcgcatgttccacggtatcaaaaatagccgtcgtagctagcaaattcttaaaaatagcttccagtctagtgtcgaatgtcaccaactcatctgccatcccaaggaaacctgggcttgcagcaatagcatcttgattctgactagaaatcgtacgcgccttgatcgttgtcaacggaaggaaggttgcacgaccagccctgtttcgtttaaggaaatcaatcgccttggttgccgcgttttcatcttccacgatgatatgctgactgctggctccaagcgcaatctctagggcaatttgataatgcacatcaaaggtcagatgctcactaactgcaccaataattccaccaaggcgggctttttcttggagaacactcttaacacctgcataaaagttactatgatttctgaggatattttccaaactttgggctctagcctgcttgtttttgagattatccagacgggcaaagagttgattttgttgagcctgataggaagatttctgattctcttgctccttggcaatagcttggtagtcagccaataatttctgaacatgctccttggcagcttcaagctcgtctttttgctgactagccttctctttagctgtagccagctgttctttcagcttttctaattgatctgcttgtttttgagaaagctgacgactattttccaactcattctcgatgcgagtcagttggtttgagacatcagcttcttcttgtagaagagctacaaagcgttcacgtaagagttcaatcatctgatcaggatcatctgaaaaagctagcaattcagcttctaaacgattgagtttttgattattttggactagattttcctctaacagagttaatgagctttctttatcagatttttcttggctgagtaaatttctcttatcctccaaagcagccaaacgagcttgtgcttcctgttgattcagggctacttgttcagattctaatttcgatagggctaattttctctctaaatcactaatcagactggtcaaatccatcaaactgccttggtctttggccatttcagcctgtaaatcttggcgttgctttttaagagtatgattttcttcctctaatttttcacgcttttggtaataactagtcaatagttcctgaacctgtgccaactcttcttctgtcaaatctagttcagccttattttccttgatttgagcagctaaaacatccaagtaaatagctttacgttggccttccaaatctagaaacttacgagcattttcagcttgcttctcaagaggcttgatttgattgtccaactcatagataatgtcttctagacgatccagattatcctgggtttgctgcagtttactctcagtttcttttctgcgagtcttgtattttaaaactccagcagcttcttcaaaaatagctcggcgttcctcaggcttagagttgaaaatctcctcaaccttcccttgggaaatgatagagaaggaatctcgtcccaatccagtatccaagaaaaggtcatgaatatcacgcagacggactttcttgccgtcaatcttgtattcgctatctccactgcgatagatatgacgttctaccctgatttcttgacctgcatccttgataaatccgtcatgattatccaaagtcacaactacagaagcataattgagcggtttgcgactttctgttccagcaaagataacatccggcatcttgccaccacggagactcttgacactagactcccccaaagcccaacgcagactttctgtaatattcgactttccagatccattgggcccaacaactgccgtcacaccttggtcaaagactaccttagtcttatcagcaaaagacttgaatccctgaatttcgatttcctttaaatacatgaatccagccctttctcaacggcatttttggcagcttcctgctctgctagtttcttagaacgaccttgaccttgaccaatgctcttaccttcaacaagaacttctacttcaaaaaccttatcgtgggcaggacccgtttcagaaattacctgataacgaatagccacatccccattgacctgaagcaactcttggagatgggttttgtagtctgtaatcatctcaaattcgcctgcttcaaccttaggaatcatgacttgatagataaattccttgactttggccacatccttgtccaaaaggagggcaccaagaaaggcctcaaaggcatcaccaagaatggtatcacgattgcgaccaccagatttttcttcccccttacccagcttgataaactgatcaaactgacaatcacgcgcaaaaccagccaaactctcctcacggacaatcatagcacggagtttagataagtcaccctcaggctttttaggatattttttatacagatattctgaaatcaatagctgtagaacagcgtctcctaaaaattccaagcgttcattgtgtgaaatttttaagaggcggtgctcattggcataactcgtatgagtaaaggcagtctccagtaaatttttgtctgcaaattcgattgcaaaatggttctttagtacagtttgtaattctttcataccaacctctttctaactgataacagtcctttttattatatcaaaaaaagccccctgagtcactttaaaacgggactggagagcatttgggaattctttaaaaagagattttcagttttaagggccaatttagggctgtgtaaagaaaaaagccctattaaaggctttttaggatgtttacatccaccctgagggaatcgaacccccatctcaagaaccggaatcttacgtgatatccattacactaagggtggaaacttgttttattataacagaaatttgctctaataacaagtttttttctagtgagatagcccgtcttagtgggaagcatccccattccagatggagtttttcacgataacataatcaacgtgtttaaggtcagcaacctgacgtccacctgcataagaaatagcactttgaaggtcttgttccatctcagttaaagtgtcttgcagatgacctttagcaggaagcaagatacgtttgccttccacatttttgtaagcacctttttgatattgtgaggctgaaccataatattctttgaactgttcaccatcgacttcaatcgttttccctggactttcaatatgtcctgcaaagagggaaccaatcatgaccatgctagcaccgaagcggatagacttggcaatatcaccgtgagtacgaattcctccatcagcaataatcggtttacgtgcagccttggcacaccaacgaagggcagccaattgccaaccacctgtaccaaaacctgtcttgaccttggtgatacaaaccttacctggaccgattccgaccttagtagcatccgcaccagcattttccaattcacgcacagcttctggtgttcccacatttcctgcaatgacaaaggtatctggcaattctttcttgatgtgttgaatcatagaaatcacgctatccgcatgaccgtgggcaatgtcaatcgtgatgtactcaggagcatcagatttgagctggctaacgaaatcatactcataatccttaacaccgacagagatagaagcaataagcccttgctcatgcatgcgcttaataaaaggaatacgtcctgcctcatcaaaacggtgcataatgtagaagtaaccacctttagccagttgctctgctacattttcatccaaaatcgtttgcatattagctggcacaacaggtagtttaaaggtgtgatttcctaaagtgacacttgtatccgcttctgcacggcttttaatgacacatttatttggaatcaattgaatatcttcgtaatcaaaaattggaaattcatttaacatatcgatgtctcgtttcttttgtaatgacctacctatgcttgcgcatctctacgccttttccgacgtttccttaattaattataaatcaaagtacagattttgtcaaataattttataaattaaaatataatgttcggatttttcttgcgtaaatagaaaaaagaggggaaattgttttctccccactccttctctattctaataatactcaccctggcggtagtcccatgagttaaaggtgtctgaaaggtgcatcatgattttatcaatgtcaagtcctttacgaatcacaactggtgctggtgaagttgagcgagctcctccttgttctgggatgagtttgccgtccttatcgaccatagacaccatcacaccttgctcatagcgagtttcaatcgttttgtcaggctggatagaagcaacgtagtcatctgcctcgataacaaggtccactgctccttcgatacgttctccaataccttctactttaccacggtttccttttccagatgggttagctgatgaggcataaaccatcttgccttcttcccaaagtttggcagccaattgttcaccagctttaccaaatttgataacaaaacagctcgttccacgcacgtcagtcatcagctcttcacgaccatcaccgtatgctttgagtttttcaaaagcttctggtttccaaggaaggatacaaccaagaagaatatcttcatcccaatgtttttggtagaaggcttcaatttctgggttaagttgtgctaaagcacgaagctcatccatgctaccgcagagaacaacacctggtttgttacggttacgctctttggctgcgaacttacgctcaagtcctgccttatcgctggtcatgataatgtaaccaactttagtagggcaaacgatacatccgccctcaccttttaaaatgtcatagccttcttgtgaaagtgttccgttccattgaatgtgttttgtcatagttctatttccttttctaattttcttctaatcctgccagtaggctggtcgttgtttttcataggcagcaatcaaatcttcatactgcaaggtaattccgatatcatccaaaccatttgagagcttgtgtttccactcgctatcaatttcaaaagtgaactctccaaccggtgagatgattttctgttgttccaagtccacagttacctggtcagtcggtttgagctgggctagcttttctctaacctctctaggctgaacaataggcaacatgccattattgagttcattattgtaatgaatatccccaaaagatcctgcaatcacgaccttaaaaccatagtctgctaaggcccaagctgcatgttccctcgaagaacctgccccaaagttatcccctgagataagaatactggctttacgatattcaggctgattaaagacaaagtcaggatcctcagtatacttgtcgtccagataacgccaagcatacatgaggtacttaccaaagccttttttatcaatcaacttgagaaactgcttgggtaggatttggtcggtgtcgatattatcattcatgagaggaacggtcgttcccgtataaactgtaaatttctccatatcctctccttactgggcttctggcatttgccgaacatctacgaaacgccctgcaatagctgccgcagctgccatagctggactacagagatgagtcttagcgccaaagccttgtctgtcttcaaagtttcgattgctggttgaggcgcagtgaacaccatcagggaccttgtctggattcatccctaggcacatagaacaacctggatctctccactcaaaaccagcgtctaggaaaaccttgtccaagcccaacttctcagcagctcgtttgacaggacgagagcctgggactacgatagccgttaagttaggagcaatcttcttccctttaacaaatcgcgcagccagttgcaagtcgctgagacgagcattagtacaagaaccgataaagatatagcctagttcaatatcagctggcttttgaccaggctccaagtccatgtaattgtaggctcgctcatcattcatatccttaatttctgggaatctactgtcaaagtcaacccccatagcagggttggttccccaggtcaccataggagccaagtctgaaacatccatctggataaccttatcgtaaacgacattctcatcactgacaagggtcttccaatctgccacagcctcttcaaagtcctctggaacacattcccgtcctttgagataatcataggtggtttgatctggattcatgattcccatcttggatccaaactcgatggacatattgcagatggtcattcgttcttccatgctcagtgcatcaatagcttgtccacgatattccaccacgtagccaacgccgcaagcaacgccgtacttggcaatcaaagctaaaatgaaatccttggaataaactcctttttgaggaacaccagtgaattccaccagcattttcttgggtttgacctgccagagggtctgtgtcgcaaagacatgttcgacctcactggtcccaattccaaaagcgattgctccgaaagccccgtgggttgctgtatggctatccccacagacgatgaatttccctggttgagttcttcctgtttctggaccaaccatgtgaacgattccttgcttttcagaaccgtgggcagcatgttcgatcccaaattcctcaacattttcagcaagcttatcaatttgtaccttagaaatcacatctcgaatatcgtagatattgactgtcgggacattgtggtcaaaggttccaaatgtcaagtctggtcgtctcaatctacgacctgcgtctcgtaatccttgaaatgcctgagggctggtcacttcatgaatatagtgctggtccacatacatgagttggggttgcccctcttctcctgtgatgacatgacggtcccacaatttatcaaaaatcgattttcctgccatccattacctccaaataaaatataaggctactagtgtggtcaccatcccaagaaaccaaactgttttaaagtaccattttcgagtcttgtgatgaaagatgattcctgctaaccaagcaccaaaaccaccacaagtaaaggctaaaataagtaagattttctcagggatgcgccaagctcttctcctcgccttggatttgtcaatgccataaatcaagaaaatgatgacattccaaatcaaaaggactagagtaattttttcgtctaacttcataaccttgcgataatagcttccgtcatttccttggtcgaagcctgtcctcctatatctctcgttaatgtaccagctgccaaacttgcctcaacagcacgctcgacacgctctgcatcctcataacgtccaaagctgtctctcagcatcatggccactgataaaatcatggaaataggattggcaattccttgacctgcaatatcaggtgctgaaccgtgaataggttcatagagacttggtccattttcagaatgactggctgatggcataaccccaagtgtgccagatagaacgcttgattcatcagatagaatatctccgaaaagattctccgtcacgatgacatcaaacttagcaggattagtaatcataagcatggaagctgagtcgactagctggtgttccaaggtcacatcttggaaatcctttgcgaccttctcagctactttccgccagagttttgatgttgccaacacgttttgcttatcaatactggtaaggatttttctccgacttcttgcgatttcaaaggctttgcgaataatccgctccacttcctcatagctatagtcgttgatatcacgcgcttttctttcttcaagaatatgatccccaaaataaatcccacctgtcaactcccgtaccacaacaaagtctacaccagcaattcgttccggtttgagtggtgacaaatgcttgagactgtcaaagatttttacagggcgaatattggcatagagattgagttccttacggagagctagcaagccttgttcagggcgaaccgctgctccatcatactgaggactaccgatagccgctaggagaatggcatctgtttctctacatgctttgagggtttcactaggtaaaggatggcctgctgcatcaattcctgcacctccaaaaggtcgtttgtctatttcatagtcaaagcctgttttttcagctagagcttccaaaacttctaaaccagcctccatgatttctgggccgattccatcccctgccagaactactattttctttgtcatagctttctcctttacacactaggcatatcacgataggaaacactgcgtcccatctcaccagcattctctttttgaacaaaggtattagcattgatgtaggcaatagcagatgctttcagtacatcgaaatcaagccctgctgcattaaagatggtttctgtatctctgttttcaacagtgaccaaaacccgagcttgggcatcaattccatctgtcacagcgtcaatagtataggacaccaagcggacggattggttaaagaacttatcgatagcgttaaagattgcttcaacagaaccttgccctgacgcattgaaatcaactttctcaccatccatattggctaggctaacgagtgcttcaatgtcattatctgcatgagtttgaagttgtaaatcatcaaagtggaagccttctggattttcaaccatggttccagctaccagagcacgaatatctgcatctgtgatttcttgtttcttgtcggccaatgccttgaacttagcaaagagtggtttgatatcctcttctgtaaagtctaaggccagttctcttagtttttcaacaaaggcatggcgacctgacaattttccaagtgggaggctgttactcttgacaccgaccaattcaggggtgataatctcataagtaagaggatttttaaggactccgtcttggtgaataccagattcatgagaaaaggcattgccaccaacaacggccttgtttttaggaactgggatacctgagaagcgagaaaccatttctgacgtattgatggtttcatttaaaacaatactagtttctgcttgatagtaatcttgacgaatactgagggccactgcaatttcttccaaagcagcattaccagctcgctccccgataccattgatagtcccttcaacacgtcctgctccgttcttgacagcagcaaggctattagctactgccattccaaggtcatcatgacagtgaggcgaatagataatctgacgttccgtcttgacattctcaatcaagtatttgaagatagctccgtattcctctggtgtggtaaatcctaccgtatcagggatattgatataagatgcacctgcatcgaccgctgtttgaacaacttgcaggaggaaatccaactccgttctggtcgcatcttcaggagagaattcgaccacttcaaacttggaacgtgcataagagacatgctcactgattgcttccaaaatctcttccttgctcttattgagcttatacttacggtgaatcggactggtagcgataaagacgtgaacctgtggatacttggcatccttgagagcttcataacaagcatcaatatcagatttgacagagcgtgccagaccagttaccgctgttttcttcaagactttggcaatctcctgaactgctgtgaatgaatcaggactcgccgctggaaaaccagcttcgatggctgaaataccccatttctccagctgtcttgcaatggcaattttttccttgattgaaaagttaacacccggtgtctgttctccatcccgaaggctggtatctagaaattcaactgttctcataagatttccccttttccaaatgtggttttaaaaaaacatctcgctcagaagtccaagcgagatgttgattcactcccgcttggtaagccaaacaggactaatgctttttgcactagcccgagtacctcaacaacaaagcaaattgattaaacttagctgttttcatgtttgactttctccttcgtttgatatcttgtttagtattttagcataggcaaaagtacttgtcaagaaaaaaattcaatattttctgaaaatttcttcagtagagaatattttgctaattgaaagttcttgaaaaatcttgaaatgtttcattttttagtggttaagttccaacttttttccatcaattccagtacttcttcatctgataaagtatcatcaagcgccacactaatccagtaacgtttattcatatgaaaagctggataaatgcccttgtgtgaaagcaaatcagctacttggtcatgcttgaggttgactgcttccatttgtccctctcttcctttttccagcttatcccaagagattttcatcaaaacggcataccacttttgattgccttcatgtcttaacactgccgtatcaggcgatttctcccacaaatactccaactgattaccatacttttcctgaacttgagtcatgattcgtttagtctgaggacagatataatcctgcacatcaaaacaagccttccgaatctggtagagaatctccagacaagcctcacggacacttgcaacaaaacttcctttaaaactttccatatagacttgaggatagaggtcaccagtctcctggtcaaagacttgaaaactcacattatcagcagtgatggacaaaaccatgacaaagtcaccttgcaaaatctggcaactataggtccagactccactattttctacaaaaccataagcatgagctttttcttgattaaactgataggatttaaaaatttcaaacataagtgaaaactgctaccctaagcagcagttcctttctattttttaaaagacaaccttagttccgtgcaattgtgtcacacctagctgatcgataaaggtttgacggttgtcaaggtcaatccccccaccaggtagaatttcaattttacctttagcacgctccaaaattctgtgatagcgagcaaagcgtttctctagcgagtctccagacacacccgcacgagtcaggattcgagtgattccagcttgactgagccagtcaatagcttccagttgatcttcatcgctcaattcatcaaaggccatgtgaaagacaatttccatcccttttgatgcagtaattaacttttcaagattaggtttatccaacttcttatcagcagttaaaaccccaaatacaactccttgacttccagactgagcagtcaaacgaatatcttctagcataatagcaatttctaggtcattatagacaaagtcgccaccacgtggacgaatcatggtcatgatggtcgtattgtagttagctgccaattcaaccgctgccttggttactccatagcttggtgttgtcccaccaactgcaagattatcacagagttcgattcgacgagctccagcctgcatcgctttttcaagcaaggtcacattttcagcacaaaattcgtaaatcatttgattctccttgagtattactttgaatttattatatcatattgttgtgaatatgctttcaattttatcaaggcaaataactactattttaactattctttgtctggaatgaccttgaaaagataataggtgataaagatggtcaaagcaccaagaccgattttgactggtaaaagaggggcaaaataaatggaaattcccattaagatgtagatagatacgatgatttttttctttcgttcacgcgcaatagacttagtctcgcgaaaatcagcaacatatgcttgatagagcttggtatggtaaagccaatcttcgaagcgcttagaacttctggagaaacaagcaatagacaacaaaagaaaaggcgttgtaggcaacaagggtaaaacgaccccaacaatagccaaggccagcgataaaaaaccaataataagataaataatacgcataactactcctagttaatactcttcgaaaatctcttcaaaccgcgtcaacgtcgccttgacgtaggtatggttcctgacttcgtcagtcttatctgcaatctcaaagcagtgctttgagcaacctgcagctagtttcctagtttgttctttgattttcattgagtataaaataatcttcttctagtttcgcatacaatggtgaattttgtcaagttctaaccaaaagagcctgaaatttactttcgggctcctcctcttatttaatcttttcttcttcgtagtcgccattactacatacaacctgcttaccaccaccacggacttttttctccataaggaagttgccacattttggacagtcacgaccaacaggcttatcccaagaggtaaattcacagtctggatagcgattgcaaccatagaagaggcggttacgttttgttttacgttcaataatttgtccctgatgacaacttggacactcaacaccaatctctttcacgattgcttgggtatgacggcaatctgggaaattgctacaagcgtagaacttaccaaaacgaccaagtttaatgaccattggactgccacacacttcacagtcaaatccagctggttcatccttaatctggattttctccatttcttcttcagccttggcaacctctttagagaatggtttgtaaaaggcatcaatgacacgttgccactgctcttttccgacttcgacatcatccagtttgccttccatttcagctgtaaaggtcacgtttacgatatctgggaaatattcaacgatgagcttattaacaatttctcccaactctgtcggttcaaagcgtttggctgcaaggcgaacataataacgtttctgaatggtttcaattgttggtgcgtaggttgacggacggccaaccccattttcctccaaggtcttgatcagtgtcgcttcagaatagcgagcaggcggttgagtgaaatgttgctctggtttgctatttacctgcttgactacatctccaacagccatgtccggtaacatcttattcttgtcagaatcattataaatggcaagataaccatcaaacttaacctgactaccattggcagcaaattgaactccattttgcgacaatttaacagccatagtatcaaagacagcagctgtcatctggctagccacaaaacgattccagataagggtatagagcttgagctggtccttgtccagatacttagcaatactttcaggtgtattaaaaacgctagacgggcgaatagcctcatgggcatcctgagcacctgaagcatttttaaccttgctaccatgcttagaatacttgctaccaaaacgatccgtaatgaaacttgcagcttcattttgggctacaggactgatacgggtcgaatcagtacgcatataagtaatcaaaccttggacaccagaaccaatattaatcccttcatagagctgttgggcaaccatcatggtctttcgagtacggaaattgattttattggcagcatccatctgcatagatgaagtagtataaggtaatggagcattgcgtttgcgctctttcttatccacctgatccactgaaaagtctttactagtcagacgagacaagacttccttgacctcatcattgctagtcagtttcagctttttgccatctactccatagaaggatgcctgaaattgcttggttccctttttaaagacaccatcaattgtccagtattcttcaggctgaaagacattaatttcattctcacggtcaatgattaacttaagcgcaatagattgaacgcgccctgctgataagcccttcttgaccttcttccacaaaataggcgaaatcgaatagcctaccaaacggtctaggacacgacgagcctgttgggcatcgaccaagtccatatcaatcttacgaggttctttaaaagcatttttgaccgcatccttggtgatttcattgaagaccacacggttggcatcattttcatctaagttgagaatatgggccaaatgccaagaaatcgcttctccttcacggtccgggtcactcgccaggaagactttattagcttttttggcttctttttttaagtcattgatgagagggccctttcctcgaatattgatatattgcggttcataattattttcaatatcgacagacatactggatttcttcaaatcacggatatgcccgacactggctaaaaccttgtagtttctgcctagatatttttcaatcgtcttggccttagcaggcgactccacgattactagattttttttaactgttgattttttcttttttgttgccgtagccacagtatcacaccttttcaaagtaataaactttataaagtgtaaaccattttgccataactgtcaagacttagctactatatatagaagaaaagtttatctagtaagcggactttcttcttatactcaatgaaaatcaaagagcaaactaggaaactaaccgcaggttgctcaaagcactgctttgaggttgcagatgagactgacgaagtcagtaaccatacctacggcaaggtgatgctgacgtggtttgaagagattttcgaagagtattaaaattcaaattccgcaagaacatcctgcccgctggtgaccaattttgccccttcttgaatcaaatgatggcaaccgtctgatagtccatctaaaatgctaccaggaatagcaaagacatcgcgcccttcttccattgctctctcacaggtaatgagactacctgaacgcatcttagcctctgctacaatcacaccacgacaaagtccagcaatgatacgattacgggcaggaaaatgaaatttcagaggttgttcaccaggtccgtattcacttagaaccagatggtcattgccgatgtagtcttgcaagcgtttattggctttaggataaaacacatccagtcctgttccaatcactgcaatggtttttccgccattctgaagagctgccatatgagctgctgtgtcaatgcccttggctaagccactgacgataaccagttcattttccaagccctgaatgactttttcaactgacttagctccctgtttgctacacgcacgactgcccacgactgctaccttcgggaatttcaagaggtcaagatttcccttgtaaaataaaagtacaggcgcatcatatatttcactcaaatcccaagggtaacagtcatctaaaatagagaaagatggaaatttttgaaactccttctccaaatgcgcatcgtctatctgaaagtaacgttccataaaaacagctggatttctgcaacctgatatttctgcaatatcacccaacaaaagttcttgatcgacattttcaccgtattctagaactgccaaaacctgttgattggtcaaacctgattttttcaatttatagatttcatagtttgtgattttcataaataactccatttctttttctactcatctatttattcgtaaaaaaatcaaaaaacatccgactatttcagccagatgttggaatctttaattttcgtttttaagaatttcttctaatttatgataatcttggacactatcgatttcatagatgctattgccttctaattcttcaacatagacatccagctctttgatattatccttaaccatattatcccagtagagatcaacaaattcaccacttgcataggccttatcgataaagctgacaatcttttctgcagttggagcatcccagaaggatacaccactaaggatgcgacccgccttgctatcaacaataatgtcttgaaccttgtagtcatctccatagaccaagaaccattcgttggtacaatcttcacgataaacactaaaataagtcgaacgtgtcaaatcattgcggaacatatttttaaagagataattatcggcatcaataacataactgttagctaattcttcttttacaagatagagagagtaaaagttattgtagtcagcgtatttatcattgaagacgaggcgaacaccatatttttctttcaagtaatcgaattgttctttaaggtaaccaacaatgatgatgatttcattgattcctttttcttttaaaaactcaatttggtattcaatcaagggtttttgattaacctgaaccaaggctttaggggtattttcagtcataggacgcaagcgagttcccaatcccgctgctaagataatggctttcacacgaatctcctttattctttaataataatataaactccagcaatgacgacaagtgacgtaataattgtcagcatatctagcggtgcacccaagaaaacaactgcaaataagactgtccaaactacataactcacgttcaagcctgtagccttggctggttgcaagcgattgatagcgatataataagccaaataggaaatcatatcaaaggctgcaaagacaatcataagacctagcaattgtccattggccacttctgcaaatgactgatgagagaagagcacaatcacaagataggacaagaatgaagttacttgacggattaagagggcttcgatttcactcaattcactttccatggcaaaagagctaagaacactctcacttccccatgcaatagcacaaaccaaagcacagagaatcccaatgtagaaggaattgacctgttcaaccttataggtctgagcaataatccctgcaatartcaagacaatcccaaatacagtattttttgaaatcttgtgcttcaaaaagaagaaagccaataaaaccgaaatcgcagggtaaatagycgacacagatgaagctaaggaacttccgatatacttaaccgcataaagattggcctgcataccgatagggcctgctaataaggctccgataataacactaacattgcgaatatttaagaaarttgagagacgaactttcccttcttttatcaaaagaaaagctagtaagataaagatactcaagaaatcgtgagcagcagccaccacaaagggcgacaaatctgtaaaaatcgaaaagatataagcactaatcgttagacccaacccccagaaaatacctgagagtagaccaaaagaaactccatttttatttttcatctgaacctccataataagctaaacctttaacagctctttggtaacgacttacaccatagtcaccaaaatctgcaccttgctcttccttatagacagtccataaactccaaatagtatcttgtaaaattttataaatagtaatcttttctcgagagacaggtgttttgtcactttcataatgtgacaagaagacttcttcctcttggggagtgaattcagactctaaaaagagggcagctaaatcccacattggatcgttcattgatgaatattcccagtcaatcagatatagacgtccttgaggtgattcgataaagttttcaggcaccaaatcgatgtgacaagattttctgtcaacacctaagtcagccagtcttttctctaaggagaagacttcttctcgaactgcttcatagttagcatacgggattttttcttcaattaaggattcgtattttttgatttcttcaaaaggagcaaattctccccttaattccttaccagatgcatgaatggtttgtaatattagagcaattttgtcaaatttagtcttgattgacgttgaatcaagcgtaatcgcagattcgatatactcatttactttgataccagcttcaatatcaaaaagataattttttacatctaagtctaaatcctttagtagttcaagattgtacttttcatcttgacgattgataagcttttctgtccctttaccaaagaacttaacaatgtattgcttatttgttgttttgaccaaatagttttgattggtcattccccccaattgttcaacactgaggacttcctcttcttgactaagtaaggaagaaattttctctttaatgattttctccacaattaacctccagttcttatacttcccatttaaacacggttttaaaggctgtgtttaaatcggttgcaaagacacggtgaatatctttaatttctcttacaggttcttctagataaaggatatttttaagacgattggcaaatttcttgacttccatcatttggattgcattttcaaaatcaatgcgaccagaacgagaggaaccaaccaagagcaagcctttttctaaggcatcgcgtgtattgagattgactttatactcactaactcccatcataagaatcgttccctgaggacgaatatagcgaaccaaatcattaatagctggtccagtaccatcaccaccacaacactcaaaagcatggtcaaaggccaaatcttcaggaatattatcagtaatatagcattctttggcaaaagagaagagttccaacttttcccaatgacgaccaataaccacgatctctgcttctggcaaagtatagttgataatattggcaaccacaaatgctaaacttccatctccgataacggcgattcggtcccgcttgctatgagcaagggtcaataggcgattcatggcatgcataccgacactgacaaactctgtaatggctgcaaccgtatcttcgatagcatcataagccaccacacgatctttagggagagaaacaaactctctcataaagccatcaaagccactagacaagaaatgggtccctgtcatgtagttttcatagaattcttcatcactctgcataggtggctgattaggaatcatgacaactttttgtccaacttcataggttcctgtcggatcagaaataacggttccacatgactcgtgaatcattgccattggaagttttttattcaaaatctttggatcacgttttccctggtagtaacgctgatccgcatgacagacagccatgtagttgggacggataaggatatgattttcttggtcaatagcctcttcttgatattttacattgataaacttaggcttagttagttgataaatttgattaatcattttactagtctttctcaatcatactttttgcaatcttcaaatctgttacggttgtaattttcagatttgaatattcacccttggccaaggccacatcttttcctttaatgacaaagattttacatgcatctgtcaagatttctttctcttcagcagaaagagagccataaaggtccaggaaatccttgcaacggaatgtttgaggtgtttgtccttgataaaggtgagcacgatttggaatatctgtaataaattgaccattggtactttcaacgatagtatcaaccgcttctaccactgtgtccactgcatcatgattttgggcaagttggatattgtcttgaatcatgcgaagtgtaataaatggacgaacagaatcgtgggtaacaacgatatcctctggagtaagcggacgataagcatcaatggcttcaatgattttctcaatacttgtattgcggtcagcaccaccttttgtaatgatgatacgttccttatgaagaggaagatatttatctacaagatcttctgcatgagaaacccagtctccatgaaccccaactacaattttttcgatacttggttccaagacaaatttttcaattgtatgaatcaagataggtcgatcacctaactctaaaaattgttttggcaagttactgattcccatgcgtgtgccagttccaccagcaagaattcctgcataaatcatctattttctcctttgtcttactaaaaaaacttattctctctattataccacaatctagtcctatcataaaagaaatactagtcgtcccgttctagaataggaggattatgcagttccattattcaaagaaactagtccatttctagtaatgactaggaattctgtagtcattaccaataaatagctgtgaaattttagagttcttcagaataatatagttttcttaaagaaagcttaaaatcaaactttgaaacttcaaagtgattacttgacttactgcccttcatttcttattagctaactttatgatataatgaaaaacgaggtaaattgaatgaaaagtataaaattaaatgctctatcttatatgggaattcgtgtcttgaatattatttttcccatcttaactggtacctacgtcgcgcgtgtcttagaccgaactgactatggttacttcaactctgtcgacacaattttgtcatttttcttaccctttgcaacttatggagtctataactacggtttacgggccatcagtaatgtcaaggataacaaaaaagatctgaatagaaccttctccagtcttttttatttgtgcatagcttgtacgattttgaccaccgctgtctatatccttgcctatcctctcttctttacagataatccaatcgtcaaaaaagtctaccttgttatggggattcaactcattgcccagattttttcaatcgaatgggttaatgaagctctggaaaattacagttttcttttttacaagactgccttcatccgcatcctgatgctggtctctattttcctgtttgtcaaaaatgaacatgatattgttgtctatacacttgtgatgagtttatcgacactgattaactatctgattagttatttttggattaaaagagacattaagcttgttaagattcacataagtgattttaaaccgctctttctccctctaacagccatgttggtctttgccaatgccaatatgctcttcacttttttggatcgcctcttcctcgttaaaacagggattgatgtcaacgttagttactataccatggctcaacgaattgtgaccgttatagctggtgttgtaacaggagctatcggagtgagtgtgcctcgtctcagttactatttgggtaaaggagacaaagaagcctatgtttctctggttaacagaggaagtcgaatctttaacttctttatcatcccactcagttttggactcatggttttaggaccaaatgccattctactttacggtagtgaaaaatatatcggaggtggtatcttaacctctctcttcgcttttcgtacgattatcctggccttagataccattcttggttcccaaattctctttacaaatggctatgaaaaacgtatcacagtttacacagtctttgctgggctactcaatttgggcttaaatagtctcctctttttcaaccacatcgtggctcctgaatcctacttactgacaactatgctatcagaggcctctctacttgttttctatatcattttcatccatagaaaacaactcatccacttaggacatatctttagctatactgttcgatactcgctcttttcactttcctttgtaggaatttatttcctgattaatttcttgtatcctgtggatatggtcattaatttgccatttttgattaatactggtttgattgtattgctatcagccatctcttatattggtctacttgccttcaccaaagatagcattttctatgaatttttaaaccatgtcctagccttaaaaaataaattcaaaagatcataggagtttaaaatgaaacaactaaccattgaagatgccaaacagattgaattagaaattttggattatattgatactctctgtaaaaagcacaatatcaactatattattaactacggtactctgattggggcagttcgacatcagggctttattccttgggacgacgatattgatctgtccatgcctcgagaagattaccaacgatttattaacatttttcaaaaggaagaaagtaaatacaaacttttatccttagaaacagataaaaattactttaacaactttatcaaaataaccgacagtacgactaaaattattgatactcggaatacaaaaacctatgagtctggtgtttttatcgatattttccctatggatcgctttgatgatcctaatgtcattgatacttgttataaactggaaagcttcaaacttctgtctttcagtaaacacaaaaatattgtctataaggatagccttttaaaagattggatacgaacagccttttggttgctccttcgacctgtttctcctcgttattttgcacataaaatcgaaaaagaaattcaaaaatatagtcgtgataatgggcagtatatggcttttatcccttctaaatttaaggagaaggaagtcttcccaagtggtaccttcgataaaacaattgatttaccctttgaaaatttaagccttccagcacctgaaaaatttgatactattttgacacaattttatggagattatatgaccctaccaccagaagaaaaacgcttctacagtcatgaatttcacgcttataaattggaggattaggatgcagtatttagaaaaagaagaaattaaagaaattcaactagctctgctagactatattgatgagacttgtaagaaacatgatattccttattttctaagttatggaaccatgcttggagctatccgccacaaaggtatgattccctgggacgatgatatcgatatttccctttatcgtgaagattatgagcgcttattgaaaattattgaggaagaagaccatccacgttataaggttctatcctacgacacttcttcttggtacttccataatttcgcatcgattttggatacttctactgttatcgaagaccatgttaagtacaagcgtcatgacaccagtctcttcatagatgtcttcccaattgatcgctttacagacttgagcattgtcgacaagagttataagtatgtagcccttcgtcaactagcttatatcaaaaaatcacgcgctgttcacggtgatagcaaattaaaagattttctcagattatgtagctggtacgctctcagatttgtcaatcctcgttacttttacaagaaaattgatcagctagtcaaaaatgccacaactaacactcctcaatatgaaggaggaattgggattggtaaggaaggaatgaaagaagtctttccaattgatacctttaaagaactgattttaacagagtttgaaggtcgtatgctgcccgtccctaaaaaatatgatcaatttttaacccagatgtatggggattatatgacaccaccatcaaaagaaatgcaagagtggtatagccacagtattaaagcttatcgcaaaaactgattaagcagtagtttacaagaaaaaatataacaaaaaagagaagatcgttataccttctcttttttctatttaaatcgcttctgtgacaaaactacggctttccaatactttgagcatggcgttagctgtatctagggctgtgaagaggggcactccgtgttcaatagctgaacggcgaatttgctctccatcttcgtcagcagttcgttttgttccaactgtattaatgatagcttgaattcttcctttgcgaacaaaacttggaatatccttatcgtcatcaccaatcttaccaacaggttgggcttgcaatccatgactggcaaagaaggctgctgttccttctgtcgcgaggattccatagccaatattttggaaacgacgagccaagtccaaggcttcttctttggcatcatcagcgatggtaaatacaacgttaccaaaagttggcaagtgtaagtaagaagcttcaaaagccttatagagagctttttccaaagtcgtatcagaacccataacttcccctgttgacttcatttcaggaccaagtaagctgtctaccttagctagtttggtaaaggagaagacaggtgccttgatatgaacgcgggtactttcagggtaaagtccatcttggtagccaagttcttcaagtttttgaccaagaatgagcttggttgctacttgagccatagggatattggttactttagaaagaaatggaaccgtacggctggcacgtggattgacctcaataacgtagactttttcatccttgatgacaaactggatgttcatcattccaaggcagttaagaccgattgctaggcgtttagtatagtctgcgattgtttcttgcaccttttgcgacaaggtttgtggtgggtaaacggccattgagtcacctgagtggacaccagcacgttcaatatgctccatgatacctgggatgaggacattttgtccgtctgaaatggcatcgacttcacactcttgtccgacgatataagagtcaacaagaactgggtggtctggactagccttaaccgcagtacgcatataagagcgaaggtcttcttcgttttcaacgatttccatggcacgtccaccaagtacataagatgggcggacaagaactgggaagccaatcttgcgagctgcaagaactgcttcttcttcattggtagccgtttgtcctggtggctgtggaatatccaaatcttttagagcttgctcgaagaggtcacggtcttccgcacggtctaggtcagctacttgcgtaccaagaatagtcacacctgctttagccaatggctcagctaggttgatagctgtttgaccaccgaactgaacaataacaccttttggttgctccaagtcaatgacgttcataacatcttcaaatgtcaatggctcaaagtaaagcttatctgatacagagaagtctgtagaaacggtctctgggtttgaattcatgatgatggcttcatagccagccgcctgaatagccttaactgaatgaacagttgcgtagtcaaactcgaccccttgaccgatacggattggaccagaacctagaactagaacggattccttatcagacttgatagactcgttttcccaaccataggttgaatagaagtatggtgtttcagagtcaaattctgccgcacaagtatctaccatcttataaactggaacaatcttgttttccaaacgaagctggcgaacttggtcagctgtagtattccagagttcagcaatcttacggtctgaaaatccattcaattttgcagttttcaagacttctagatcttgtggatgggcacctaactcttgctcaatttcaaagatatgtaagagtttatcaagataaaagatatcaatcttggtcaattcagcaatttcttctggtgtgtagccacggcgaatggcttctgagacatagaaaagacgatcgtcttgggctttgactactttttcaatcaagtcatcatctaaaacactggcaagttctggaatctcgttatgatgaacaccgatttcaagtgagcgacaggccttaagaagtgattcttcgatgtttcgaccgattgccatgacttctccagtggccttcatctgtgtcccaagacggcgctcacccttttcaaacttgtcaaatgggaaacgaggaatcttggcaacaacgtagtcaagagctggttcaaacatggcataggttgaacccgtaactgggttgatgacctcatccaaagtcaaaccaactgcaatcttggcagccaatttggcaattgggtaacctgtcgccttagaagcaagggctgaagaacgtgatacacgggggtttacttcgatgacatagtatttgaagctatgcggatcaagggctagctgaacgttacatcccccttcaatcttaagggcgcgaataatgctcaagctcgcatcacgtagcatttggttttcatagtctgacatggtttgcgcaggggcaaatacaatggaatctcctgtgtgaatcccaactgggtcaaagttttccatgttacaaacaaccaaagcattgtcagctgagtcacgcatcacttcgtattcgatttccttgaaacctgcgattgaacgctcaatcaaacattgggtcacaggtgacaatttcaatccattttcagcgatttcacgcaattcttcctcgttggcacacataccaccaccagtaccaccaagtgtaaaggctggacgaacgataactgggtaaccaattgtcgctgcaaaggcaacagcttcttcaacagtgtttacaatttcagattctggaattggttgctccaattcttccatcaattgtttaaagaggtcacggtcctccgcttggtcaatggcagataatttagttcccagaagctcaacaccaagctcatcaaggataccatttttagacaattccatggccatattaagaccagtttgcccaccgagtgttggtagcaaggcatctggacgctccttacgaagaatacgtgtcacaaactcaagtgtaattggttcaatataaaccttatcagcaatttccttatccgtcatgatagttgcagggtttgagttaaccaagacaacctcataaccttcctctttcaaagacaagcaagcctgggtcccagcgtagtcaaactcagcagcctgaccaataataatcggaccagaaccaatcaccataattttttgaatatcagtacgtttaggcatagtttatgatacaaagcccataaagaacacagtgaaaataggaaactcggtgcagacgccttcagcgtcaagacgatgattatctttttcacacagttcttagggcgtgttcacttccgcgaacaatgtatcttctcctttctattcgtcgcctcacagggcgacattaaataagatacaaaggacgaatagaaagcgattgaattttaggaaaccaaggaaggattgacaatcccagttggtttatctaaattccgagctttccgtccgtgttcagttacataaattctccgacgagcttttactcgttcttagtttgattgtttaaaagcttccatcatctctataaactcatcaaataggtagctagcgtcgtgtggaccaggggccgcatctggatggtattggacagagaaagcaggttggtatctgtgacgcacgccttcaactgacttgtcattgatttcttcgtgggtgataatcaagtgttctggcaaatcctcacggctaactgcataaccatggtttttgacttgtaaaatccacacgtcctgtagcaatttcgcgtaccgcatggttgaatccacggtgtccaaatttcatcttgtaggtcttagcaccatttgccattgcaaagagttgatgccccatacaaataccaaagattggaatttttccttgcacaccgcgaatcatgtcaagtgcttggggaacgtcttctgggttacctggcccatttgacaacataactccgtcaggattaagatgaagaatttcttctgccgttgtcgtgtatggaaccacggtcacattacagttgcgcttcgaaagttcacgtaggattgagtgcttgaggccaaagtccactaacaccacgctcaaaccaactcctggagctggataggatgttttagtagaaacctgcttaatattgtctgtcggcaataccgttgcctggagctggtcagtcacatgatccatgctatctccaacatgggtcagagttgcacgcatagtaccatgcttacggataatcttggtaagggcacgcgtatcaatccctgaaataccaggaattttcttggctttcaaaaattcatccaaggtcatttgatttcgccagttgcttgctctacgtgcttcttcgaaaacaacaacccccttacaagtaggaataatggattcatagtcatcacggttaattccgtaatttcctaccaaaggataagtaaaggtcaagatttgtccattataagactggtctgtaatggattcttggtagccagtcatacctgtattaaagacgatttcgcctgttacatcaatatctgctccgaaggccttgccttcaaaaactgtgccatcttctaatactagaagtctttttgtcatattttcacctctcgtggacgctcactggcgtcttttaacgtcttgtgttttagttggcgtttctactcgccagtacggattctaagattgccattcgaacaaagacaccattggtcatttgttggacaatccgtgattttggtgcttcaaccaagtggtctgcgatttccacatcacgattgactggagctggatgcatgaggattgctgtttctttcaaacggtcataacgttcttgagtcaagccatgttgggcatggtagtcttctttggaaaagactgcaccgctatcatggcgttcatgttgcacacggagaaacatcatgacatccacctgatcaatgatttcatcaatagttacaaactgtccatagtttgcaaactcttgacttctccattcctcaggtccagcaaaaaagagttcagctcccaagcgtttcaaaatctgcatattggatttggcaacacgtgaatggtccaagtcacctgcaatcgcaaccttgagaccctcaaagtgaccaaattcctcataaatagtcatcaaatcaagcaagctctgactagggtgttgtcccgaaccatctccaccattgatgatggaagtcgtaatcgtcggacttgcaattaactctctgtagtagtcaacctctgggtgacgaatcacacaaacatccactcctaaagcagacagagtcaaaatggtatcataaagtgtctcacccttattgactgaactagtcttcacatcaaagtcaagtcgctccaatcccagtttaatctctgccacttcaaaggacttatgcgttcgtgtagaatcctcaaagaaaagattggaaacaatcggatggtcctcatagggaagctgagctccatttttaaactcaattcctcgcttgatcaatttcatcacttgatcgacagtgaggtcttccatggacaccacatggtttaatgcttgttgattttctgacatggctactcctttagctttctaagcttcttcagtaatcagaactctatcttggccatcaagttctgccatctctacgatgatttcttcagaacgactagttggtatgttttttccaacgtaatctggacggattggcaattctctatgtccacgatcgactagaactgctaaactcacgcgcgcaggacgaccatgacctacaatattatcaatagcagcacggatggtacgacctgtatagagcacatcatccaccaagataacttcgcggtctgtcacatcgacagaaaccaaagaagtatcttctccactttttacatcatcacggaaaggtttagtatccaattccacaacaggaactgaaagattttctagttgctccaaacgttcttggattcggtgggcgataaagacaccacgagttttaataccagccaagacgattttattcaaatctttgttgcgttcgataatctcataagtaatacgcgtaatcgctcgtttgacagtcaattcgtctacaacttcttttgccttcatgacaaacctccaaaaagaaaagtctccttaaacaaggagacttgaaatgtatagccaagcgagccctactgcaaacagtatagacttcaccctactacttaatcgttctccttgcctgcctcacgggacaggtttaaaggaatatttagttatcaaatactatagcacaaagcatgcttaaaatcaagcaaaaactttcgatgttccatcttacaaattgctaaaatcatataattgtgggtactggtcacactctggatttttaggatgacaaatggctcttccaaaataaatcatagcctgatgagctgctaaccactgctcaggcggcaagatatccataaccctcttttccacctcaagcggtgtagcagatttcttgacaatatcatgatgcttgcagatacgctcaacatgagtgtccactgcaaaggctggaatcccaaagcccacactcatgacaacattggctgtcttgcgaccaacacctgacaaactctccaattcctctcgtgtttgagggacttgaccatcgaaatcgtctagtaactgttgggcacatttttttagaaatttagccttatttcgatacagtcctaggcgagaaatgtgtgaggcaatttcactttctgttgcaacagacatggcttgtggcgttggaaaggcagcaaagagacctggtgtggccttatttaccgctgcatccgttgtctgagctgacaacatgaccgcaaccaagagttcaaaatgattagtgaaatcaagactgggcttggcatctggaaaaagagcaatgatttcttctagcacctttcgtgctcgtttttttgacaagaccattattcgtctccatcaaatagtccttgtaagccagcaaaaggactgttttcttcttttttgactgcttgttgagcttggtattcttcttctgtcatgatttgccagtcatttcctgaaacaaatccttgaccagcttcttcttcagccgtcaagaccttgataggaatgtttagtaggatattgtctgatacgctctcagcaagatcaagttccccattttcgataggcaaaaccaaatcatcgtctaaaacttcctgatctagttggttggttgcgccttccatgaaaacttctgtgactggataagactcagccaactcaactggctccatactgcggctggaagcaagaacaatggtatatgacaactgatagtctaaaaaatacatccggtcttcgtactgtactttcccaactgcaaggatatcttttacatctaaaatttcttgattgcgtgcacgcaggtctgcggctaggtctaacgtttgttcaaaatgcaagccttcagactgcttacgaatttcttgaatatttaatttcatacttcctccataaagatttactctcttgattataccatgaaaaggctacaaatcagcacagcaaactttataattgaaattcaattttttaacatattcactatgacatttttgttttttagtgctatactataggcaataatacatccgagcaaggaggatgttcacatggaagataaataactcattactaatgcaacccaactcttatccgagttaaataaaagtttccaaagctgcaaacagggtactgcagatgatactcgactacaagagctgctaaacactactataaaagagctcaaaaaagcggaaaagttgaacaacagtatcttaattgaccttgagaaattttaccaacgtaccagtcttctgataggcctcggtagcctaaaactgaacgaccaagcacgtaccgcttggcgcaactatgacaagttccattacgatcatgtcaaacacgtactaactctttatggacctgtttttggattctagagattagaattgtcggttttctgttgacaaaatatcctgaaaggtataggatagaggtactaatactcggaggtaagggagacatgaacaactaagtctatcaagtaaagaaactttatttagtagatcttgtttttgtctctttttgtgtgctctttttatactaggtttctagtatcttgtcctcattgaaaataaaaaaactagaaagctatgctcctcttgggttggggtaggcagctccaagctagtttgacgagtttttcaacgaggataatagagtttcgacagtgactttgggctctactagataaagtagagctttttgttatgcactatcgacattctagaaagggcaacaatatgataaaaatcaatcacctgaccatcacgcaaaacaaagatctacgagatcttgtatctgacctaaccatcactatccaagacggggaaaaggttgctattattggtgaagaaggaaatggcaaatcaaccttacttaaaattgtaatgggagaagctttgtatgatttcactataaagggagacgtccagtctgactatcagtcactggcctatattcctcaaaaagtccccgaggagctgaaaaaacaatctctacacgactacttctttttagattctattgatttagactacagtatcctttatcgcttagctgaagagttgcattttgatagtgatcgtttcgcaagcgaccaagagatcgggagcctctccggtggcgaagctttgaaaattcagctcatccatgagttagccaaaccctttgagattttatttttagatgaaccttcaaatgacctagaccttgagacggttgattggctaaaaggtcagattcgaaagattcagcaaaccgttattttcatttcccatgatgaagactttctttctgaaacggctgataccattgtccacttgcgactggtcaagcaccggaaagaagcagaaacgctagtagagcatttagactatgatcgctatagtgagcagagaaaggctaattttgtcagacaaagccagcaagctgctaacgaccaaagagcctacgataaaaccatggaaaaacatcggcgagtcaagcaaaatgtagaaactacgcttcgagctaccaaagacagtactgccggtcgcctattggctaaaaagatgaaaactgtcctctcacaagaaaaacgctacgaaagggcagctcagtccatgacccaaaagccacttgaagaggaagaaatcagacttttcttctcagatatccaaccattaccggcctctaaagtcttaatccaactggaaaaggaaaatttggccattggcggccgagttttggttcaaaaactacaactaactgtccgtggccaagaaaaaatcggtatcatcggccaaaatggtgttggtaaatcaactctgctagccaagttacagcaacttcttaatgataaaaaagagatttcccttggttttatgccacaagattaccagcaaaaactgcaattggagttatccccaatcgcctatctcagcaaaactggggaaaaagaggaactgcagaaaatccaatctcgcttagccagtctcaatttcagttatcaagaaatgcagcatcaaattcgctccttatctggcgggcaacaggggaaacttctgcttttggatttagtcttgcgcaaaccagactttctcctgctagatgaacccacacgaaacttttctccaacttctcaacccgaactcagaaaactctttgccacttatcctggtggtctcatcactgtttcgcatgaccgtcgtttcttaaaagaggtctgttcaagcatctatcgcttaacagaacacggtttagaggtagttaatttagaagatttataaatttgcaacatagcaaaaatccagagacaacctctggattcttttttacatatgttttaaacgttcaatccgttctgagataggtgggtgggtataaaagagtttttggaaccctccccctttcttgggatcattgatataaagtgcactgctggcatcatcgacaggacgactcatcggtttactattatccaacttacatagagcattaatcatcccttgaggattacgagtcaactcgacactggaagcatcagcaaggaattccctctgacgagaaatagctagttgtaccaaggtggcagcaagaggtgccagcacaatagctagtagagaaactacgagcataatgatttctaagccatttccatctcggtcatcatcacttcgtctgcgacctgctccaccccaccacatcatacgaccggccatactagaaagcatggtgatagcactagcaagggcaacagcaatagtcgaaatacggatatcgtaattacgaatatgactgacttcatgtcccataacagcttctagttcttcacgattcatgatagcgaggagacctgacgtcgcagcaaccgctgcgttttgagggttagaacctgtcgcaaaggcatttaaggctggatcatcaatgatgaaaacacgaggcataggaatctgagccaccatagccatatcttccactacatggtagaggtctggtgccgtttgttcatccacctcacgcgctccattcatggacatgacgatctctgtcgattgaaaaatcatggacaaggcatagataaagccgataatcagtgcgataaccaaaccaccaagcccagatcgcataaagaggtagccaaccgcatagccaacaagagctaagagtaggaaaaataccaacaataaaatccaggttcttcgtttattgcttgcaatttgatcaaacaacatcttagtcacctaaaccgctaaaatcaactttaggaactgacttttcctcttctggtgtttgaaggaaatctgctgctttaaatccaaacattccagcgataatattgcttgggaaagtttctaattttacattgtagttgctgacaacactgttgtagagttgacgggagtaagaaattttattttctgtgtttgtcaactcctcttgcaatttaacaaagttggcactagctttcaaatctggatagctttctgcaactgcaaaaatacctgaaacctgacgagtgagggcatcactagctttcatagcttctgctggtgaagtcgctgctgccacttggttacgcagttctgccaccttttcaagggtagaaccttcatatttggcataaccttttacagtctcaatcaagtttggcaagagatcatttcgacgtttcaactgaacatcaatctgactccaagcctcctttgtttgcatacgattcttaaccaaaccgttatagctaacaattacaaaaataacaataagagcgataactccaagaataatccaagtcattatataagtcctttctacttttagattagtaccagtatatcaaatttttaatgattgtggtaaaataagataatactaaagaaggaaataactatgaaaccagaaacattttacaacctgcttgccgagcagaatcttccactttcggaccagcaaaaaaaacaatttgaacgttattttgaactcttggtcgagtggaatgaaaaaatcaatctaacagctattacagacaaggatgaagtttatctcaaacatttttacgattcgattgcacccatccttcaaggtttgattcctaatgaaactatcaaactgcttgatatcggggccggggcaggatttcctagtctaccgatgaaaattctctatcctcagttagatgtaactatcattgattcactcaataagcgtatcaacttcctgcaacttttggctcaagaactggatttggatggtgttcatttctaccatggacgtgccgaagattttgcacaagacaagaacttccgtgctcaatatgattttgtaacagctcgtgcggttgcccgcatgcaggttttatctgaattaactattccctaccttaaagttggcggaaaactattggcactaaaggccagcaatgcgcctgaggaattattagaagctaagaatgctctcaacctcctttttagtaaggtcggagacaatctcagctacgccctaccgaatggagatccgcgttatattacagtggtggaaaagaaaaaagaaacaccaaataaatatccaagaaaggctggcatgcccaacaaacgcccgctttaaattttttagtaaaaaatatttacaaagttcggaatttctgctatactatcacaagcaaaggtttttaatgtcatcccgtgaggtgacgaagacgcagaaatacttgaaactctttaaagtctagattttagagaagtcttactctgagggcctattgctgtaaaataatgggctcttttttgatgcccaaaagtgaggtttatatgaaacaagaatcaactgttgatttgttactagacgttgaccaacgtccttcggcgggaaaaggaattctccttagcttccaacacgttttcgccatgtttggtgcgaccatcttggtacccttgattttgggaatgcctgtatctgttgccctttttgcttcaggtgttggaacactcatctacatgatcgcaactggttttagagttccagtttatctaggatcatcattcgcctttatcacagctatgtccctagctatgaaggaactaggaggggatgtatcagctgcacaaacaggggttatccttacaggttttatctatgtccttgtggctgcaagtgttcgttttgcgggtacaaaatggattgataaactcttgccaccaatcatcatcggacctatgatcatcgttatcggtcttggacttgcaggttcagctgttactaacgctggtcttgtagctgatggaaattggaaaaatgctcttgtagcagttgttactttcttgattgctgcctttatcaatacaaaaggaaaaggcttcctacgaatcattccattcctctttgccattattggtggttacctcttcgcactaacccttggcttggttgactttacaccagttctgaaagctaactggtttgaaatccctggtttctacttgccatttagcacaggtggtgcctttaaagaatacaatctttacttcggtccagaaaccatcgctatcttgccaatcgctatcgtaacaatttctgaacatatcggagaccatactgttttgggtcaaatctgtggacgtcagttcttgaaagaaccaggtcttcaccgtactcttcttggtgacggtatcgcaacttctgtttctgccttccttggtggaccagccaatacaacttatggagaaaatacaggggttatcggtatgactcgtatcgcttctgtatcagttatccgtaacgctgccttcatcgcgattgcccttagcttccttggtaaattcactgccttgatttcaaccattccaaatgctgtacttggtggtatgtcaatccttctctatggggttatcgccagcaacggtttgaaagttttgatcaaagaacgtgttgatttcgctcaaatgcgtaacctaatcatcgcaagtgctatgttggtccttgggcttggaggagctatccttaaacttggtccagttaccctttcaggaactgccctatcagccatgacaggaatcatcttgaacttgatcttgccatacgaaaataaagactaatactcttcgaaaatcaaattcaaaccacgtcaacgtcgccttgccgtactcaagtacagcctgcggctagtttcctagtttgttctttgattttcattgagtatgagagtctaaatacatcaaaaaacgagcatttccaattacggaagtgctcatttttcttctttctaaaaaaggaaagccctgcggccttcctttgtcttacttgcgtttcttcttcgctttcttcattttattagccatgcgtttcatagactgtttcatggcaaattcaccgattttacctttgagtccaccaccaaacatctggctcatatctggcattcctgctcctccgagagctgataagtcaggcataccaccttgtcccatcattccttcaagggcagacatgtccatccctcccatatttggcatatttttaggaaggttgtttggattgatccccatttgcttcatcatcttattcatatctccagacataacaccctgcatgagttgtttagcctggttaaaatctttaatgaatttattgacttcgacaaatgtatttccagaaccagctgcgatacgacgtcgacggcttggatttaacaaatctggattttcacgttcttcaggtgtcatggaagacacaatggcacgtttgcgcgcaatctggcgttcatctaccttcatgttttgaagtgctggattgttggccatacctggaatcatcttgagcaagtcttccatcggccccatattttgcacctgatccaactgatcgatgaaatcattgaaatcaaaggtattctcacgcattttctcagccatttcaagggctttttgctcatcgtattcttgagaagctttctcaatcaaagtgagcatatcccccataccaaggatacggctagacatgcggtctgggtggaaggtttcaatgtccgtaatcttttcacctgtaccagtgaacttgattggttttccagtaatgtgacgaacagatagagcagcaccaccacgagtatcgccatcaatcttggtaaggataaccccagttacttctaactgagtattaaactcacgcgcaacattggccgcttcttgaccaatcatggcatcaacgacgagcagaatttcgtttggttgagccaatgctttcacgtcacgaagttcattcatcaaaagctcatcaatctgcaaacgacctgcagtatcaatcaagacatagtcgttatgattggcttgagcttgttccaaaccttgacgaacaatatcaacagctggtacttctgttccaagtgcaaagacaggcacatcaatttgttgacccagagttttcaactggtcgatagccgcaggacggtaaatatccgccgcaatcatcaaaggacgagcattttcttccttcttgagtttgttggccaatttaccagcaaaggttgttttaccagccccctgcaaaccaaccatcatgatgattgtaggaatcttaggtgacttgataatttctgccgtatcagaacctaaaacggctgtcagttcctcatctacaattttaataatctgttgcgcaggattaagggtatcaatgacctcatgcccgactgcacgctcacgaactttcttgataaagtcctttacaacaggcaaggcaacgtcggcctcaagcaaggccaagcgaatttctttggttgcctcttggacatcagattcagagatttttccttttttacgtagatttttaaagacgttctgcaaacgttctgttaaactttcaaatgccatttttcttcctcttattctctattatcaatacttgttaaaatttctatctgctcctgcagaaagtcatccttgggatagcgctccaaaatctggtcaaaaatttgactgcggacaatgtagtccgagtacatgtgcaatttcatctcataatcttccagaatcttttctgtccgcttgatattatcatagacagcctgacgactgacgccgaactcttcagcaatctcagcaaggctgtaatcatcagcgtagtagagctcgatataattcatttgcttatctgtcaaaagcgccgcataaaattcaaagagcgcattcatacgattggttttttcaatttccataacttttattataccaaaaattagcctaatctaccacattagcaggctaatccgagaagatagctagcaaaatttgaaaaagacaagagactatccccaagtaatttccaattgatagctggcaaaaggatgtccctcttgattttgtagttgataagctagctcaatcttttgcccatcaacttgataatggttcgtttggatgataaactcctgcatgcccataggtgtaggaatataggctaaactatcgctatcctttagaaagcgcataatggtcttgggattggaaaatcgactcatcaccagttcttgaccatgaaatttaataaccactttttccttttcctcattatagaaaagcaggtagctataatctcctttttcatgcacttccacgtcataaagttggtcaatcacttccaactgctcatcaaactgaatcgtatttcgcatccgaatcttcacatcaagtcctctttcttgtctcttgtcctactattttaccaaaaactctagctttttgctataatggtcatatgaacgaaaaagtattccgtgacccaattcacaactacatccatgttaataatcaaatcatctatgacttgatcaatacaaaagaatttcagcgtttacgccggattaaacaactggggacttccagttataccttccacggtggagaacacagccgcttctcccactgtctaggagtctatgaaattgcacgacgtatcacagagatttttgaagaaaaatatcctgaggaatggaatcctgccgagtccctcttgaccatgaccgctgctcttttacacgaccttgggcatggtgcctactcccatacttttgaacatctctttgatacagaccatgaagccattactcaggagattatccaaagtcctgaaacggagattcaccaagtcctgctacaagtggcacctgatttcccagaaaaggtagccagtgtcattaaccatacctattctaacaagcaggtcgtgcaactcatttccagtcaaatagatgcagaccgcatggactatctcttgcgcgactcctattttactggggcatcttatggggaatttgacctgactcgcattctccgagtcattcgtcctatcgaaaatggcatcgcctttcagcgcaatggcatgcatgccatcgaggactatgtcctcagtcgttaccaaatgtatatgcaggtttatttccaccctgcaactcgggctatggaagttctcctacagaatcttctcaagcgggctaaggaactttatccagaagacaaggacttctttgcccgaacttctccacatctcctgccattctttgaaaaaaatgtgaccttgtctgattatctggctctggatgatggtgtgatgaatacctacttccagctctggatgaccagtcctgataagattcttgcagacctgtcgcaacgctttgtcaaccgcaaggtctttaaatccattaccttttcacaagaagatcaaaaccagctcgccagcatgagaaaattggttgaggacatcggctttgatcctgactactatactgccattcataagaacttcgacctcccttatgatatctatcgtcccgaatctgaaaatccacgtacacagattgaaattttacaaaaaaatggagaactggccgaactctctagcctgtctcctatcgtccaatcccttgctggcagtcgccacggagataatcgtttttatttcccgaaagaaatgttggaccaaaacagtatctttgctagcattacccagcaatttttacacttgattgaaaacgatcattttaccccaaataaaaactagaagaggaaatttatgagtattaaactaatcgctgtcgatatcgacggaaccctagtcaatagccaaaaggaaatcactcctgaagtcttttctgccatccaagatgccaaagaagctggtgtcaaagtcgtcattgcaactggccgccctatcgcaggtgttgccaaacttctggacgacttgcagttgagagacgagggtgactatgtggtgaccttcaatggtgcccttgtccaagaaactgctacagggcatgagattatcagcgaatccttgacttatgaggattatcttgatatggaatttctcagtcgtaagctcggtgtccacatgcacgccattaccaaggacggcatctacacagccaatcgcaatatcggaaaatacactgtgcacgaatcaaccctcgtcagcatgcctatcttctaccgcacccctgaagaaatggccgataaagaaatcgtcaagtgtatgttcatcgatgaaccagaaatcctcgatactgctatcgaaaagataccagccgaattttacgagcgctactctatcaacaaatctgctcctttctacctcgaactccttaaaaagaatgtggacaaaggttcagccatcactcacctagctgaaaaactcggattgaccaaagatgaaaccatggctatcggtgacgaagaaaacgaccgtgccatgctggaagtcgttggcaaccctgtagtcatggaaaacggaaatccagaaatcaaaaaaatcgccaaatacatcaccaaaacaaatgacgaatctggcgttgcccatgccatccgtacatgggtactgtaaaaggaaagaatagataaaaaccgctcagctgagcggtttttagtataaatatatcacaataagagtaaatcaataaattgaatggctgttgcacagtcacttaaatcttgatagtacaaaaacaaaatgaacagctgttatatcaaatggagactttataactctggtaattctaccttcaagctcatatccgtcggttgcaataccttctgaaccgcagcaagaaaggctagtccattatccgatggaaaatattggaaagtgatatgaatgacttttttgtcaaagttatcgccatatcgctctacatattgcttgctttcgaggaagtagatgtagttgttgattttttcttgcagaatttcaagatggactgcttctatttcttcctcccagccaattggatccacaaggagtaactctaaatgactatctacaacaccaatagagtctagttcgctaggtttcagttttgaaacgataacttgtgtaacgatttgattaaattcttcaggagaaaatattttttggttatcagataaatcattaaaaattagatcaggattatttcgtataaaaattttgtctgactcttcttgtgtatattgcttttttgatttccaaaaaccatattgcgcataattcattaactctttaccagtatgttctcccgacatatagctatcggcagcttctttggggatttctctaatcacttctgggcaggtaatattaaaagttggataacgcaagaaatacttgtcaccatcttgacagatttccaatatatctttttgactagtataaatcgacttcatttttaatagctattagctccttgtgtttttttaaatattttttcccataccattcctctacagtcttaccttcccactcacgatactcttcaggatatttccatttgtagaatgcttgtaaataactaggaaattcgatgtaaattagcatagcaatcacagcaatatttaggataatccatgttatcaaaagacctaatccttccaatgaagttgaaaattttatggaaaaactttttataataaagtttataattactccaattcccaaaaaactcattccataaatcgctatcttattggcaattttgttgcgaagagaagagccacttccattaccatacatcagttttttaagattttcaatttcaaggctaaacataaaataggctaatatagtaataaaaacaaaaatagcagcaaccatccaaatagataaagttggtaatgacatatcaatcgctaacagattaaattcaagactaagccaaattagaaatgtgatgacatgaaaatgattacgataaggaagtataaaagcttttctaaaaactttaccaatcaatatgataaatacccaaattaagaaacagactagatatacctcagctgttagtaatggatgttgatagataggcaatcttaaatctttaggatcagagttgtgcaaggacagcgagaaaacaagaatcataaagtttataatgacaggaccgataagagtgaaaacaatattctgaatatgaagaactagtttagactttccttccctataatatgtttctaatttagagaaaacatttcctttctgatactgtaaaaaaacatcatcttctagattaagactttcttcaaaacttgcgctaaaaatagatcttttcttcatgattttcacccaaatcctattttaataactccttgtgtttttttaaatatttcattccataccactcttctaaagattttccctcccactcgcagtattcttcgggatatttccatttatagtaagcataaaggaaataaggaaactccataaaaataagcattgcaattaaaccaatgtttaacaaaatccaacatatgaagagacctaaaagagttacggaatgtgaaaaattaatagagaaggctttgaaaatataattaacaatcacagctaatcccaatagacctgctccataaatagcaaggtctttagcaattttatcgagtaaggtaggtaacttaacttctccatacattagattttttaaatctttaagttctatccttaacatccaataaattaaggctaaaagaatacaaccaatagcaaaaagccctaaaattgttagaaatggtaatgctaaaccaatagcagcgagatcgaactctataacaaaccaaatcaaaaacgttatgacatgaaaatgagtcctatatggaagaataaaaaatggtttgaaaaatttaccaattagaactaagagaagccatataaataacccgattacataaacatgagccgttaaaaaattatgattagaaattggaaagactaaatcttttgggtcactagtataaagcattgttgaaaaagccaataacaagaaattgatgccaattgggaaaataagtgtcaatataccatataaaacagcgtttttaaaatagtcaaatacattccttggaggtttggacatttttttatcttgttccttcaattgatactgtaaaaaaccatcatctaataaatttaaactctcttcaaaacttgctttaaatagcgacttttttgtcataagtttaatcctcaatcttcttttctactaattctgagtgctttttcaagtatctctttccataccactcttctacagttttcccttcccactcgcggtattcttcggggtatttccatttgtagtagccttctaaaaagaaaggaaattccataaatacaatcatagcgattaaagcaatatttaacagaacccaacatataaagagaccaaaaccagttatggaagatgaaaaattaatagaaaagccttttaatatataattaataatcacggctaagcccaatacacctgctccataaatagcaaggcctttagcaattttatcgagtaaggtaggtgacttaacttccccatacattagatttttcaaacttctaagctccgttcttaacattacataagccaagaatgctagaagtccaaaaaataccaagatcccccatgttgttaatataggtaacgtaattgttatggccagcaaattaaattcaaacataaaccatatcataacggttacaatatgaaagcgataacgataaggaagaataaacgtccgtttaaagaatttacccattaataccaataacaaccaaattaacaagcaaattaaataaagctcgactgttagcaaaggatactgagaaatcgctaatcttaaatctttaggatcagaatcatgtaaggacatcgccaaaacgaatagcatgaaatttacacctatcggaaacaacagactaagaataaaagttttaataccaaaccaaaaagagggtctccctttcttaaagactttcccaagtttattataataatcttttttctgatactgtaaaaaaccatcatctaataaatttaaactctcttcaaaacttgctttaaaaattgatttcttcctcatacttttcacccaaatcctattttaataactccttgtgttttttaaaatatttttttacataccactcttctacagttttcccttcccactcgcggtattcttcagggtatttccatttgtagtaaccttctaaaaagaaaggaaactccataaatacaatcattgccaaaagagcgatatccgagcctatccataccaacaataatcctaataaagttaaatgaggcgaaacaactattccagtattggataaaattatctttaaaattacagcaatccctaatactccggaaccatacaaggcaataaaacgcaccactctatcaactagagtattctcacttacctcaccaaagaaacgattttttaaaattcttctctcagtacgaataaataacaaagcaagaataaataagagaaaatagataccagcgatacctactaatgtgagagtcggtaaagctactgttattcctaataaattaaactctatacctaaccaaattaaatatgttaaaatatgaaatcgatgtctatatggacgtataaatggctctcgaaaaatttttccaactataatcaacccaagccaaataaacgaaccaagcaagaaaatttcaggtgtcaatagttgcggtttataaatgggtaatgtaagatccataggatccgcattgttcaaagaattagcaaaaactgctaaaagaaagtttccaccaaaaacaaagaaaatactaaaaagaatattcttaatcctgaaaccaatacttgggattccattatttaatccctttcctaaatgttcgtaatactctttctttgaatactgaagtggagcatcatctaataaattcaaactctcttcaaaacttgctttaaaaattgatttcttcctcatacttttcacccaaatcctattttaataactccttgtgtttttttaaatatttttttccttaccagaaatctagatcctaatacttaatccgatctcataataaggagagaaatcccaaccaaattagtacatatattttctcctattataccacacctctgttttcatctgaaatggtttccattttaggacaataaaaaaacactgagcattcagtgctttttcgattgaagtactgccccctgccggaatcgaaccagcaactactccttaggagggagttgttatatccattgaactaagggagctagataaaaactctgctgaaaaagcagagttttttagtcgaattaacgacggatttctttgatacgagctgccttaccttgaagagcacgcaagtagtataatttcgcacgacgtactttaccgtaacgaacaacttcgattttttcaacacgtggagtgtggattgggaagatacgctcaacacctacaccgttagagattttacgaactgtgtagttttcagaaatgccagcacctttacgtgcgataacaacaccttcaaaaatctggatacgttcacggttaccttcgacaactttcgcatgtacacgaacagtgtcaccaggacggaatgatgggatatctgtacgaagttgaccttcagtcaagctttggattaatggattcattttattctcctatctttgtcaatcttgaggaaccttcctcagcggataaactgtatttttgtgcgtccattacacacaagatacagtttaccaaatttccacaaaaaagtaaagaaatttatagcagaattcctaaaaaaatcgcaaccaaaccacctaggtaggttaaggctaggtagctataaaataccttcttatcacttaacagtctttggagttcgtcattcaaggtagagaaggttgttaaacctccacaaaaacccgtcgctaaaatagcatagacttccttagactccacatgattgtagaataatccaattaaaaaacaacccaaaagattggctattagcgttccgagtggcaatttagaatcttgattatagcgggaaaagaaatagcgcactaaagctccgaaaccacaagcaattgcaagatagaccattaccatttcttcctccccaaatagtaagccaagagcaggcctccaccgatgctcaaaagcaaatacaggactaaactaagataacgccctgtatcaagcagtttcacagcatcaagcattagactagaaaaggttgtcaaaccaccacaaaaacctgtacccagagctaaaataacacctttactggttcccttatagactaagtagcccttaacaagatacaccaggcagaaaacacctagatagttaacaagaagggtgccccaaggaaaatctggactggctggtaaccaagtagaaactagatagcggacaagtccgcccaacatggcagctagaaaaatccctagcggataaaattgttcttttttcatttgatgttttgatcctgataatcacgcgaacgtttgagtatgtccgaaaaagtcgctacaatagtctcctgatagcgcttatctcctacgcgacttctaaccttttcaaaaataaccgcttctctcttagtatctaaaatcggtttacctgaagctttcttataggcaactacatcctcaaccaaatgcattcgttcttctaacagtttgacaatttgatcgtcaatttgatcaatttctttacgaataatatctaaatccatacaatctcctcctttatttgaattattgtatcaaaaagccaccaaataggctagtaaaatcccaactcacaataagaaaaatgcactgattgattgcatcagcgcacttttatacttatcctacttttgcagccaattcttctgcgaattgttccaagcgttcaatgtcttcttcctcagcagagagatctactttaacacactctgaacctttttctgctcctgtcgctacaaaaacgcgatcaaagtcatcgacagccttacagaattcgtcgtagaaggtgtcacctgaaccaacaactccgtagattttaccattcaagttgagatctgctaggtcttcgtagaagtccatcatctcatctggcaattctccatcaccataagtataggtcgcaacgatagcgatgtctgcttccaagaagtctgaagcgtcaacagttgtacattcatcaacatcaacatccaagcccaagtcacgtaatttgtctgctacaatatctgcaatttcttcggtattaccggtcatactggcaaatacaatttttgctaatgccatatcgtcctcctcaatttatctttctccattatatcacatctttttcattttaaaaataaaaattcttgtgctacaatgaaatgagaaagaattgaggttatttatggacatttgccatcaaattttagaaaaaattaaagaatacgacacgattatcattcatcgtcatatgaaaccagaccctgatgccttgggaagtcaggtgggattgaaagctcttctcaaacatcatttcccagaaaaaaaccatcaaagccgttggttttgatgaaccaactcttacttggatggctgagatggatcttgttgaagatagtgcctatcaaggagcccttgtcatcgtctgtgatacagctaatactgctcgtatcgatgataagcgctatagtcaaggtgattttctcattaagattgaccaccatccaaatgatgatgtatacggtgacctatcttgggtggatactagttcaagtagcgctagcgagatgattaccctatttgcccaaacaacccaactggccttgtcagatcgagctgctgaattgctctttgcaggaattattggtgatacaggtcgcttcctctacccttctaccactgaacggactctccgccttgctgcttatttgagagaacataactttgactttgccgctctcactcgcaaaatggacactatgagttacaaaattgcaaaacttcaaggctacatctacgaccatctggaagtggatgaaaatggtgctgctcgcgttatcctgagtcaggaaatcttaaaacgattcaatgttaccgatgctgaaactgccgctattgtaggagctcctggtcggattgacagcgtcagtctctgggggatttttgtagaacaggctgatggtcactaccgtgttcgcttacgcagtaaaatccatcctatcaatgaaattgccaaggaacatgatggtggaggccaccctctagcaagtggtgctaattcctacagtctagaagaaaacgaaatcatctatcaaaagttaaaaaacttgcttaaaaactgataaaatacttgccaaacttttcagaatctgatagactagtatggtaacaatctatggctcgcaaagagaccatggcagaaaggaaatattgcaaaatgaaaaaagatatccatccagaatatcgcccagttgtcttcatggacacaactactggttaccaattccttagcggttcaacaaaacgctctaacgaaacagttgagttcgaaggcgaaacttacccattgatccgtgtggaaatttcatcagactcacacccattctacactggacgtcaaaagttcactcaagcagatggacgcgtggatcgtttcaacaaaaaatacggtctcaaataatgataaaaagaacagtttcgactgttctttttatcttctttttatgaaccaatcactactactttctatttgtcaaccatcacgctgacactataattgatttcaaacggggttaaaaaatatcgaaaagaagcttgatattgagaatggtcaagatgattgaaactacgtagcctagaattgtgttccacttagcattggtaaattctcccatcactgacttcttagaagtcagataaattaagggaaaaattgagaatggaagagcgattgaaagaaagacctgtgaatagaccaataactgatctaaggtcttttcttgatgcccaaacaagacagcaactatcatcacagggagcaaggcaaaaatccgtgttccgacacgaataacccactgtggtaatttcatatgcaagaaaccttccataacgatctgtccagtcaaagtacctgtaatagtagaattttggcc

SEQ ID NO: 64 - DNA, 88437 bp, Streptococcus mitis NCTC 12261 contig10
tcctagcatgactgcaatcagtttaatttcatcttcccttgcaatgtcaagtctctaaccaaatctcgcgcctggtccatctttttagtcagaataaactgagttaaatcaaaaatattgtcctgcaaggtcttgggaattgcgttaacaatatcctcttcctcgataacagagtcttctttataggactgtaaaaagaggagatttttctggatttcgctaaattggaaaccagacttgatgaggagattttcaaaagaatgattggcaaactgcagaccttgtttctgactccacttttgaaaatactggcgcaattcttgttctttggcttctactgcatcaaagaccttggcatcacgcttcagtaatttaaccaaccgtcttttactatccagctttccttctgcaaagattaacaacttagttattggtgaaggattgtcaaggtattcctcaaacgacttgagctcagcatctgttaaaaagcgtttcttggctgttgtgatatcgacaaaatggtctaatatcacgattttctcatccgcaaagaaaggaaggctgaccaactccagttctacatccttataaaccacttctttcatatcaaagtaggcaaagttgaggtcagcagaatcatagccaatctgtttcaacacttgactcttcatcacttcaaactgaccctggtctgtccctgtaaataggctcagactaggtaaatttgataaagtcaacttctggctttcttcaatagctagcatcttctctcctttcttctgatttttcgatttaatttagtcaatgtagcgcaatttcccacggaaatcttctaagctctcataccctttttccgacatgattgctttcagttcattggtaatacgttcgaaggcaccaacaccttctttgtgaagggtggttcccacctgtaccatactagcaccacagaggatgtgttcaaaagcatctcgaccagtcagaacaccacctgttccaatgatttggatttgaggattgagacgttgataaaaagcatgaacattggctagagcagtcggtttgatgtactccccaccaatcccaccaaaaccattcttaggtcgaataacgacagattcatcttctatataaaggccgttcccaatcgagttaacacagttgacaaacttgagcggatatttattgaaaatagctgccgcttggtcaaagtgaacaatgtcaaaataaggtggtaatttaatcccaagaggtttggtaaagtaggcaaatacttctgccaaaattcggtcagttgtctcaaaatcataggcaatctgaggtttacctggaacatttggacaggaaagatttagctcagtcagaccacgaaactcactctcttggacttttttcaagatagtatgggtttcctctggagacattccaactaaggatagaaagaaggtacgattcggttccttttcttgtaattccagaagatagtttaggtaataatctaagccattatttggcaagcccatagagttgatggaaccaagtggaacatcttgatagcgtggctcaggatttccctgacgaaagtccaaggtcgctgtcttcgtgacaaaggttcctgctgctgagtttttaacgccttctaactctgctatcgtcatacaagccacacctgccgcattcatcaaacaattgtcaaactcaaaaccagcaatttgcgttttcgttgataccatgattctgatcctccagattccttttattgctaatattataccacattttcagattttctctttaagaaaggcatttataagaaaaacgttcgttttttatctatttccaaaaagcctcaaaactaaatgtcaaaactaaattgatagaatttttagaaaatttctgtttttttctttacagtaaaaaaaaattctgctataatgactcacataattaaattagaatttaaggagaacgatatgacatctgctaaagaatatatccaaagcgtgtttgaaactgtaaaagctcgtaacgggcacgaggctgagttcctccaagctgttgaagaatttttcaacactttggaacctgtatttgaaaaacaccctgagtatatcgaagaaaatatcttggcacgtattactgaaccagagcgcgtgatttctttccgtgttccttgggttgaccgtgatggaaaagttcaagtaaaccgcggctaccgtgttcaattcaactcagctgttggaccatacaaaggcggacttcgtttccacccaactgtaaaccaagggattttgaaattcctcggatttgaacaaatctttaaaaacgtcttgactggacttcctatcggtggaggtaaaggtggatcagacttcgatcctaaaggtaaaacagatgctgaagtgatgcgcttctgccaaagcttcatgactgaattgcaaaaatacatcggcccatcacttgacgtacctgctggtgatatcggtgttggtggacgtgagattggttacctttatggtcaatacaagcgtcttaaccaatttgatgctggtgtcttgactggtaaacctcttggatttggtggtagtttgattcgtccagaagcaactggttacggtttggtttactacactgaagaaatgcttaaagctaacggtaacagctttgctggtaagaaagtggtcatttcaggttctggtaacgttgctcaatacgctcttcaaaaagcgactgaacttggtgcaactgttatctctgtatctgactcaaatggttatgtcatcgatgaaaatggtatcgacttcgatcttttagttgatgttaaagaaaaacgtcgcgctcgtttgactgagtatgcagctgagaaagcaactgcaacctaccacgaaggttctgtatggacttatgctggaaactatgacatcgctcttccatgtgcgactcaaaacgaaatcaacggtgaagcagctaaacgtttggttgctcaaggcgttatctgtgtatctgaaggtgccaacatgccaagcgaccttgatgccatcaaagtttacaaagaaaatggtatcttctatggacctgccaaagctgccaacgctggtggtgtagccgtttcagcccttgaaatgagccaaaacagtcttcgtctctcatggactcgtgaagaagttgatggacgtctcaaagacatcatgacaaacatcttcaacacagctaaaacaacttcagaaacatacggtcttgataaagactaccttgcaggagcaaacattgctgcctttgaaaatgtagcaaatgctatgatcgcacaaggtattgtttaagatttatttgctcaatcctcaatcgctttgattggggattttttggttgagttaaacagttagaaaattacttactcgcccccttttttgcccctttttaaacaaaaagaaaaaccactactcctaagaatagcggtttaatcatgtctttaagctactaatgtagtcgctctattatttaagtgttatgaataacttcaatatctttaaagctttttgttagatttataatttcaactatagccatctctactccttagtttacagcaaaaaattatgcttaatttttattgtttttgtaagaaatcagcgaacccaatactattccattcaacaatcctaaagaaataccatattcaactggaaaatctaaaaaaatagcaaacactattccaattatcacccctagtaaggctgctgttgaaattacatattcattttctttcttcattttctgtacacctcatttcctttttgtatataagctgtagtactctccaccaagagccattaagtacttatgatttcctgactcaacaatcttaccacctttcattacaaaaataatattcgcatccttaatcgttgacaatctatgagctacaattatttgagtacagccctgactttttatatactttgttattctttcctcattaatagtgtctaatgtactagttgcttcatctaaaattacaatactaagattatttattaatgcacgtgccagtgctatccattgtctttgaccacctgaaatatttgaacccatctctgagatgatagtattaaatttcatcggcatagctatgatttcatcatagacttgaactgctttacaaacttcctctatcttttgtgaagtaacttcgtgctttaaagttttattatcaagaatacttctgttcaataaaaatgaatcctgtggaactactcctaaattttgacttaatatttttttatctatttgattaatatttacaccatcaaataaaacttttcctgtatcaatcttatataattctgatggtatttttgataacgtactttttcctgaccccggttgaccgactagtgcaattctctgtcctgactcaatagtcaaatttaaattttctattacaggagctgagtctttggaataagagaaagatagatccttaatatctattctacttcaaacgtttctaaactatactccggaaaataatttaaccaataattaaccatactatctttcatcgtgtcctccaaccagtactaggtctttagatgatatctaaagacttaggtgtacacctaaacattttatccaccgacaataataatatccataaccaacaataaaattagggaattttttaaaattttcttcatatttagacttcctttcagtttttatttattgtacaataaataagaatcaattacttttttgttgggaaaacgggaaaattatgaaatcaaaacttggtataacactcagaaaaattcgaaaaggaaagaaaataagtttatcttcaattgctgatagtaatttatctaaatctcaaatctctagatttgaacggggagaatcagaaatatcttgtattcgactaatcaatattttagataaattacatataactttggatgaatttattattcttcatgacaataattctactaaaactggatcattcgctaacttggtgcaatatattcgaaagcactactccacaaaaaattttgatagtattattgaattactatcaaactcttcaagttataacttgggtccttatgaaaagacaatggtaaaatcgattctctatacaacaaataaaaattttctcccctcggatgaggagttattacagctaacagattatctttttaaagttgaaaactggggttactatgaaattatcctattaggtaactgtgtaagaacaattaaatataactcctacttcctactaactatagaaatgttaaaaaattatatctattcaacattaaataagacaaataaacggcttgttacacaattggcaatcaattgcctaattgttagtattgataaagaagaatttcaaaattgtagttttctaatcaaagaaataaaaaaattactaaataatgaattaaactattatgaacaaaccgtcttcttatatacatgtggatactttgaatttaagtgcaatcctgcgaacggaatcgaaaagatgaaacaagcacttcaggtatttgaaattctaggagaacataatataaaagcacagtaccaagagcactatgacaaatatattaatcaatagcataaaggtagttaatctttaaccaccataggattagttcttattattccaaaagtatttctatactaatttttttatcaaaatccttatcattcagtacttttacaaacatttctaaattttttattaagctctcatactcatagagataatgatctagctccttttgaaacgctcttatttcttcgcttacttgttctactgtaattgattctggcaaatttaattttgaaaagtcatatcttgcaagctttcgactgctcacatcatcactcttcaaattgataagcacttccgccatcttatttaagttggcgattttttcattaatttgatttagttttatatctatctctgctatttcttttactaactcgtctttaatgtcttggtatttcttatctgcttcagttaattcaatgaagaggttaatctcagtaatcttttcctgtagactcttaactgtaggtcttctgtatggtattactcgactatcgttggttagctgtcttatcaatgttcgtcctttgacatactgattcttatccgaatgttctttgttatagacaaagtatgaggttgtctcacgtataaagattttatattttgtttgattctcttcttccagaatatctaattgataattgggaatgaaaatgagaccactctgcttaataccaaaagacactttgatataaatgccctcatcaactagcttctctatttggttctctgcaagttccacttcaaattcacgaacggtatctcgtttttccttaaatgtctcaaaggcttcctcaatctcttcagtggatactttatccttatctcgttcttcttggaaagcatggtactgttcctgtaaattctctaatccttctgaagcaatgacttccttatttttaaaataatcttgaaaaaatttgacatcatataatttcttatcacttattttttgatgacccaaacttatcttttgattatcttcttccaggataaaagttacatttttttgttttaagtcaatggttagattcaattcttttgcttttgttattaaatcttctaaagaattgacacggttcaacaaaaattctaaacgactttcaatctcttgcttagcaaaattcattctaaaaaatttttcatcatataaatctcgcttgctgagttggcgtcctcgaattcgttttgtcattgctcgatctgtcatcatgaatcgactatgcttctgactaaaatcaatatgaacatgtaactgcaccgctttttctaaaaaatcatcaaaggaccttgactgctgcatcaaaaaataaagacgttgtttcaattcaaatttatgactagactgcctatatttttgatagtcacggtaagagaaacgcttttcaataatttttgcccccgccattctagaaatacggtctgaaatcatacgtaaatttcgttctaaggcataattccatatcaattttttatctgaattactgtctatggcattgattaagatatggttgtgggtatgatctttgtctgtatgagtcgctacgataaacttaaagcgacctcctgtcaattccatcatggtctcataaccaatgcagttaatttcttcaggtgtcagattatcttcaggagaaaatgattgaatgaggtgatgagcatgaatagtttgttggtgtttttcttgtcggtcgtttctggattcgtacaacttgtcattattggtgaagttgacattgtacatctctaccatttctgcatgactagggaagtccaagtaattgctcatgccaaaatcagataccaatttcaaattgtccgttttatcagggttgagaatatacttaattaaacgcctacgatatttttttccgtgcgtcgcaaagtgtttagtaactaccatgaaactccttcagtcttttcacctccacttgaaattctttgtccacttccttaattaactctccgactcctttactcaattcttgtaattggtcctgagaaatcagatggctttgattaatcgcacgcgcaatttgatttatgttatttccaatccgtctcaattcaaaaactaactggtcataagtatcagtgttaatcgtgacaaatgacatattgggattaagtaaaacttttctggcatagactgagaaattttgacaattgctcttagcaatccgttcattcaattggtgtaattctggatcagttagaaatacttttttgagattagtacgatagcgataaaccattacatcctcctaacccatatatttttcacggaactcacgactgagtggctgcatttgattcacttctgcaatcaattcttgaacgcaagtcaataagattgagacgtgctcttgagtcacttgatgattttctcttgcgataaccagaacttcatacacatctcgactaatctgttcaaacttttgagactgccaaagggagaaccaactttcaaaaattctatcctgataattctttttcaataaattttgacgaagaaattctgagaaactatccactttttgttccctcatcatttcttttatctgtttttcttcttgtctcgtgattctaaattgctttcggattgacttaatttcttgtcccattctgatatcccttcaacattctacttgtctgacagtgtaagtctacctcacattgtcagtacgcttcctaaagacctcacttgcttcttgttcggtctttgcgagctcagatattgtgtccacaatatcccaaaaatcatatcgcctgccatttcaaacctcacggtttaaaaaacaaacgatatgaaaatgtggtggcacgcccccaaacccccaagataaatctaaattaaaaaaagtataacaaatactttttgataaaattatcacagaaaaaagagccctatcggactcttacaaattaaaacaatgtctctgatattcatactgcctaatcccactactatctttgttcatcttgatagaaaaaacaaagtaatgatcacgattgtctaaagatttgcttttgtttaatttaaaataatgtttctgagacatagccatggtgcgtaaaatatcatcagtgataaatgttaatggtatatctaaagcagaatacttgtaaaaatctgactcaaaccttaaataagaatcagaaaaataatctagctgtaatttatcatcatataattctttacgattcatataaatctaccccttctatctgtatatcgagtatatctccccatcttaatcgaagaaaaccagagtctgatttaatggatatagactctctcccaatctctttaacaatacccgatactacttttcttctatttgagagcttacaaacaaaagttgctgggaatacattcgtataaagttgacgaacaaatagaactttctcttccattgataggaaaatggagatgtcttctctatttttttcttcccaaagagaactggaatgttctgacaaaaagaatcccatccacttagccatcccacggtcttgatactctcttgcagacaaaaaaggtaaataagaacgattcatcattttagtccatctaatcctccagctgaatgaccaccaatgagtttacttcttgcgattgttctagaagcttgatccaaggcattccctttcaatagtgaagtaaaaccaaattctgttcgaatagcatcgattgcggactggagcctttcttctttttctattttctcaacatcatcaaataatgaaatcaatccaaatgattcatctactaaacctgaatagctcactgcaacacttctgatagctcctgaagtatatttagtgtgaattaactttaaaacatagtttgtcagtagtgctgtttgattagttggttcaatcttcatttgagtatgaatagatcgtttctgttccactttagaataccctaagtgtatagaaaccacagttgctttcttaccagctcttctcaatctaacagcaacttgttctgccatctcacgaagtatgatctcaatatctctttgtttgacataatctctaggtaaaacttgagagttccctatcccttttgactttggcttataaggtttatgaacattactttcatcaatcccattagcatgaaaccataactctagtcccataatcccaagctcttttttaatcaagtcaggattagccttagccaattctttaatcgaaaagatgcctaaactatgtaatctcttctccatccgattcccaattccccagaaatctgtcattttagggatagaccatactttcttttcaatatcttcataggaccaattggctctcattgtcggagtttttttagcctcattatcaagtgctaacttagctaataagggattggcattagacatacctaccgttgaatagattcctgtttttctccaaatctttttttgaatagcagctgagatgatgtctaacttatcttttcgactaatacttttatcaggcacaaaataatttaatgaactggttaaatctataaatccttcatcaattgagtagggataaatatcttctggtgctgcaaaatcttgaaagattttttgaatctccatattgactgcaatataagtatccattctcggaggaacaatcactgttgattttgcccagtcctctatataacggacatagtctatcgttgtcggcaaaccttgttttctagcattatagtaagagaactttctagtctttacatcaaatggtaaatcataggaacgtccaacatttgatttcccaaataccttcttaaacataggagaggaagcaaggattaacccagcagaattatctgctcgactcataacacaaagtgaagtcttaagtggatgcaggcctctatctacacactccacacttgcgtaaaaagatttcatatcaataaaggcaatatcgcttttaggttcgagactataatcaaaccaagtcatactcaatcctctaaaggcataaagtttccaacaattttccctatgatacgaggattctcatcataaggcgcaaacttatctgaatagttccgattgagtgaaactaaacgtagcccattttcttcacgatacactttcttgatataggtttgaccatcccaatctatggcatagatagctccatcataatcaaatcctgtttgcttaataagggctacagaaccattttcatatgttggttccatcgaattaccaaacacccatgatgcaaagtcataatcaaattgatgattaaagtaaactgtatcgtaattaccatcatcaaaataagctgttcctgtaccagctgataatttttcgtagaccttataagcaaaacgctcaggaatgtctacaaccttctcattctgtttgttcaacaattctgtagcataatgaagtgtcgctttttgattcttttccgttagtttgagataagtttcaactatttcatactctgattcaaaatagcaagggtcgacagttaaaatctggctcaacttacttagattattttgattcggttttgttttacctgattcccaattaaagtatgagactctactgattcccaaactggatgcaagttgtgattgcgataacccttgactttctcttttttcttttaatttagtaggtgaaaacatttgttctcctttttgtaagtttattaactaacaaaagaataccatagcttgttgaaaaaatcaagagtttaataacccccaagttctaattccgagaatacatttgaaataaaaaagaatgctgacaaatcaacattctttttatgttcactttgataaacattataaaatttgtctgtttagctaccaaaaagctaccaatagatttgtaattttaaataaataaattagtagtactatatttaaatacctagttatctaaaagaataaatttactagattagtaaattaaattagactttgtcagtaatgacgttactctccttacttcaatacatttgaaagtaatgggattagttttaagccgattagaacgatgcctccaccatgaatttgtaagaacttttcatattgaaaataaacaaaagtgttgaaatatagctgattttagggaaatacttctaggtgttttcaatgtcaggctttaaaaacgtggcaaaagtagggcaaaaacgaatgactcgtatttggtttgaaaacctataatacctaatgtttatgctattctagatatatagttttgttataaataaatgtcagtgcgagttcaaatcggaggataaaatggaaaaacaaattaatgaaaaaaaaagccttggttcccaaagctttttaatgttataaactcattaaaataatccccagttagatttggaatattttttattctgtgtcatataaaaataaataaaatgaatggctatagctagagctaaaatggttgttatactcactactattataggattagaagcaaagattaaagagagaatcaaggcagccagatagagtgtcgcttggacacagtagtaacttttcgaatagcgaagatagtgtttgttatagggcccatttactaggacagcagcttgaaagaggccaaatccgatataagagaagctggttgcaaagagacgattagcttcaggattctgaagaaaactcatcgaaacggtcatcataagaagtccaatgaaaataggatagtgactgtaaattagaaatagtcccttttgattagatttttcatcaatagcatggtcgaattgaccaaaataaaacaagaacagagaaatcataataatgaaataaagaaccgaataaatcgagaaattctcgattgtaaagaagttagctagctccgtaatcatctctccaaacataataatgacaagaagggagatacgctcgattaaatgggggagatttacctggtaatgcttatctttattaagcaagatacttggcataataaatgttagcagaatactagcaaataagatatagactctaaggtaaataggaagaagagctgctagatagaatcctaaacttcctagacctgttatccatagaaaacctttgatactttcccgattagcatcatcggttgattttctaaaaaattcaaccaaatattgaaaaaataaggtaagggttaatgtaccaatagcccaacagagataatgaaaatattgttgccaatcaggtccaatcatattggctataaagagtaaaattcccattttgataaacatgattactatgttaaataaagagttctttccatagcgattggtataatcggtttgaatcatccaggaatcgatgagaaacaaagtagcaatgaaaaaatcaaggaaagaattccaagtcaaaataccgttatgaagatggtcaattaaagtagttacttttgaaattgcaaaaacaaaaactaagtcataaaaaagttctgaaaattctacacgtttatgtttaataagagttgtcatcttaagacctttctattttagaagtacaatttattataacataaaatggtaatgagagaaaaggagatgcttaaataacttcatgtgacgctaattgtcaaaaccttggagcacatttacctcacgtaccagcttacaggcggagtgtttgatgattgataatgaagaataagattatacaataaaaaaacacctataatatttagaaaaaatatcatctaaatctccttagtcatgaagtctttcgataactttcataagtggacgaatttttaatctagagacaatacaagaggacccgttctgaaaatgaactaaccgattttctttatcaattaaagatatattataaggatttacgataaatgatctatgacattgaaataaacgtggttcctgtttaagaatatctgacaattgtccataaaattcaactatgtctcgttttgaatagagagtcaacttatgagcaattgttgatgtttcaatatacaataaatctttaaaagggacttgaatttgagctttggatcctgtaaatataaaagagtcctcagatactgttattccttgattatcgctaacacttaaaataacattttcaattcgtttgataaataatggttcaggtaattctttatcaatgaaatcaatagctgatactaaatattcaaaagatacaggcataaactcagaatgagatgttacaaaagcaatcactgcttgagaatcaagttttctaatttctcwrsmamskycwaaycyyytttkgymwymwyytttwwttymawwwymarkwaaaawwawtkrwkrwttycyyyyyyykraawkkycyyywaaarsykktkrrgktttycmwwaamcyymaaawkscywwwmyymawyytwwtwwycmmcmaaawttttttkrmmammwtttymawtyywrkyykktkkwaaaaawtwwyytyywrkataaaaawawtcactacttcactcctatatatttttccactgattttttaatattgtaaagtgtcttctagaacaagcgatgtctgatactctatcatccataaacataatcgttcttgtctcatgattaaatcctgctattttatctttattcacaagaaactttctatggcatctaataagttcttctgtactttcctcttcgattttagctagtgaggttgaagcttcaaaattcccttctgctgttacaaaaagaacagcatgagcttttgtagggtgagttgtaacataataaattttagagagtgatacctttacgatagctctatcttgatataaaatgtagtctttcatatttagcctccttctatcagtttaatcttatcagaatgatggaaattaaattataaaaatctcaaatggtttctatactatctcaaatggtaaaaattttcttaatttagacatttcatgataaaatagatactttttagtatctcaataatattaatctttcttcatttgataaactaatttctaatgaaaggaaagctatgaaggcaattcaaattttacactactctttatttggctatattttatctctgtatttaaaatattatttcttaaaaaaacattcaaaaatacaaaaattttacaaggacataagattaactacaaatataaatcttctacttatcagaagttaagtaagacaatataccaaaagcctatgaaatcaacgtttctaggcttttttgtttttttaatgtggttttgtctgattagaagcaattgacgtattttaactgaaatttaaaatttctttcaaatatttccccgtttgagactcttcacaactgataatatctcttggtttgccttcgaataaaatataacccccattctttccgccctcgggtcctaaatcaattatccaatcagcttgagcaataagttctaagcgatgttcaattatcacaaccgtattcccttgattgacgaggcgtcttagtaaactaagcagttgttcaacatccttaccatgcagacctgtgcttggttcgtcgagaacaaagatttgtcctgactcttgtaacttactagctaacttaactcgttgcacttctccacctgacaaggtacttgtgggctgacctaaagtcagataatctaagccaacttccttcatgactgacagagattgacaaatcttatcgttcgaagaaaaaactgttaatgcttcttcgacagttagattcaaaatctcttcaattgtgaaattctgataacgatagctgagcgctttaggattataacggtgacccccgcactcctcacaaacgacctcaactgaatccgcaaaagccatgtcataaacgatttttccagttcccttgcaaattggacaagcaccttttgaattatagctaaaccaactagaggttacattgttggctttggcaaataattttcgaatttcatccattattcctaagtaagttgctggtgtggaacgaatggaggtaccaataggtttttgatcgatgataatggcatctgggtaattttcgataaattcgacaccaatcagagagctcttccctgaacccgcgacacccgttactgcggtcaagattcccttagggatttttgtattaacctgtttaagattatttgcagtagcatctttgatggcaaaatattctgtccaagctagtgggtcttgattcagtctaagtggttgttttaggacacgggttgtgaaggtgtcagctttttgcaactctacaagacttccttgaaaaattagcctaccgccttcccgaccagccaatggtcccaattcaatgacttcatccgctaaagctaacatttgtcggctatgttccacaaccaaaatattgttgtgcttatctcttaaatccaacaagagctgaccgattttctcggcatcatgagggtgcagacctgcagtcggttcatcaaaaacgtagttgacattacttaggctggaaccaatgtgtcgcaccaacttgacccgttgtatctcaccacctgataaggtttctgtcttccgagacaaagataaataaccaatcccaactgtctccatacgcttaatagcatacttgatttgtgcaactaatgattgacctaaaggactatcaacttcttcaagtaaaggcaagagttcactgactgataagttcatatagtcaacaatattatgcccgtttatcttagaagctaaggccttggggtttagtcctgagccttcacaactggcacaaggtacctgaatgacaagagatagcacttcttcttgcaatgattttttcagcttagaaatatcccttttcagatagaggcggtagaaacgcggaattacaccttcatagtcaacacggtccacactccccgtattattagaacgaaattcaaccttgactatttcatcgcttccttctcgcaaaatctgccattcttcctcagaaaaatcagctaactttttatctgcatcaagtaaaggattatttttgtaaagataagcctgccagccactcgaaaattgactaaaattaatagcaccttcattcaatgattttgtggtatcaaaaatcttatcctcaattaactgataaaccttcccaatcccagtacaaataggacacatccctgcaggatgattgaaagaataagccattgagccacccgcactcggttgaccaacccgtgaaaacagcagacgaataagcggagcaatgtccatagccgtcccgactgttgaacgagtattagtccttaaagctttctgattgacaacgatagatgggggtaaatttttaatttcgtctacgtgaggacgctcatagtgaggtagcttgttccgtaaaaagagaggataactatcctgccactgtctactactttctcttgctagcgtatcaaagacaagggaagacttccccgaacctgaaacacctgcaaaaaccactagcttattcttaggaatcgtcacatcaaagtcttttagattgtgctctttagcaccaaaaatttcaatactatctatttccatcaattattctccatattgtcagttaaagttaacagctcagctttagtaaattcattcttcacaagagttagatattttccttgaagttcaacatatttttgcatatcctcttgccccatgccccttattgcttctttttctgcttccactattttagcaacggtcatctctatataagttttgcctttttcagtcaaggacaatttcttactcttacgagaacttggtagtggcgtcacccttacatattggtcagcactcaacttttttaccgaagagtgaatggtttgttttgggaacatcatctgttcaaccaagtcctgctgagtgatatcaccactatttactaataaaaaataacagacccacacgctactctcagatagcccaaaattcttagccatgacacgataaagagatgagaattctttctcttgtactgataattgctttataaaatctgtttccaaaataattccttacatctcttttagtctgatttcggattaaattatatcctaaaaaaatatctatgtcaaatagagaaggaggcagtatcctcctttcaacacttagttcttattattaatcaacttttccagcctttctacagctcctctcatggtgtctttttgctttttacaataactataaataagcgggacggataggctatcatcaaaaatatcattggcgatatctagtcttgtaaagttactatggcattcagaaatgcgtttcatcagggttacccagttattgacattgctttccatgtattcttcatactgacggcacccctgccctctcagttcgataaaaactcccatttttgattcccagtctttattgaagttaacctttatctctgagaaggcataatgcctttggtacttgtttatcccccattcattgagaacaaacttatctttaggaagaatgaggattttctcaatgacatcatctggagctaagcatttaatcgttacggctaagtagtctaacatcactgagttatccatgtctaggctccaataaatttaatatcagttgccactagttttaagcctccccaatttccaccaccattattattagctcgccaactaaggtggacttctggattgacaagttctactacaagtgagttcagctcatccttttcaacggatttagccaacttgtcaagattgtctacaatctccaagcgaatacccttgaggtcatcaagggaatagcccaggtctttcaaggcttggattttgtctgtatcttgtacagagcaagtaattttagctacttcatctgtcgcaatgctttcgccattgacatttttatagactggtgcaactcgcgaagaaaggatggtcactttctttggaatgtcaaattgtgatttatccaatttcaagtcgccaacttttatagtttcgtctgttaagttaaattttgtcagtcttctttttctgagttattaaaattgattagaacttttgaggctgggcaaaatcttaattcctgaagaaaatggagtaaatcttcccacaagaaaacgcataatatcaagcttttttgaactgcaccccaaaagttagacagagaaaatctaacttttggggtatttttattatgaaattaacttatgatgataaagttcagatctatgaacttagaaaacaaggctatagcttagagaagctttcaaataaatttgggataaataattctaatcttaggtatatgattaaattgattgatcgttacggaatagagttcgtcaaaaaaggaaaaaatcgttactattctcctgatttaaaacaagaaatgattcataaagtcttacatgaaggctggactaaagatagagtttctcttgaatacggcctcccaagtcgtacgatacttcttaattggctagcacaatacaagaaaaatgggtatactattgttgagaaaacaagagggagagtacctaaaatgggacgtaagccaaaaaagagacctgaagagaggacagaattagaacgtcttcaagcagaaaatgagtacctgagagcggagaatgccatcctaaaaaagttgagagaactccgattgaaggagaaaaaagagaaagaagaaagacagaaattgttcaagaattaatgactgagttttcgttagatattcttctaaaagccattaaactagctcgttcgacctactactatcacttgaaacaactagacaaaccagataaggaccaagagcttaaagctgaaattcaatccatttttatcgaacacaagggaaattatggttatcgtcggattcatttagaactaagaaatcgtggttatctggtaaatcagaaaagagttcaacgcttgatgaaagtactcaatttacaagctaaagtgcgacagaaacgaaaatattcttctcataaaggagatgttggtaagaaggcagagaatctcattcaacgtcaatttaaaggctctaaaacaatggaaaagtgctacacagatgtgacagaatttgccattccagcaagtactcaaaagctttacttatcaccagttttagatggttttaatagcgaaattatcgcctataatctttcaacttcacctaacttagaacaagtaaaaacgatgttggaacaggccttcacagagaaacactacgaggatacgattctccatagtgaccaaggttggcaataccaacacgactcttatcatcggttcctagagagtaagggaattcaagcatctatgtcgcgcaagggtaacagcccagacaacggtatgatggagtccttctttggcattctgaaatcggagatgttttatggttatgagaagtcatttcagtcgcttaagcaattggaacaagccattgtagactatattgattactacaacaacaaacgaattaaggttaaactaaaaggactcagtcctgtgcaatacagaactaaatcctttcaataattatttgtctaactttttggggtcagtacatttcaacacctgatactatgcgttttttttgattttaaaaacttttcgcccagctcaaacaactaacaaaaattataagtatagtttattttataatttgagatctaacaatcatttcgattcgttaaatctttcaatctttcttctccagatttaagcatctctttctcaacttgattccattctccaaatagtaaatcatgaaggacggttgctgctgaagttttatcttctcctgaatcatatacacaacttctatctcgttgataaatttgaattctttcaaagatagctagttcttccgattgccgtgtattatcaactagatgatttacaatgaaatcatgatgttcttttggagttgcgcgtgcttgatttggattgatagcgtacagttcttcgtatcggataagagtactcagataggacagcttaggctttgtcgcaattaaggctaattgtacctcataccccttatttttcaagagttttgctgttttctttggaacatcaatcgttcgtaaagttccctctatcaaaagattgtatcccaaatgactcaattctcttactaaagactctaccatttttcctgcaaaatctttggtgtattctacactgtctttgccatattcttgctgcagttctaaatagtgtggatgttgagagcgaaaactatcgccatctatgataacaatatttccttgaaattctttctgtttaatacgatgaattgtagtcttaccagcaccactttgtcctccaagtaaaatcgctataggttgcttactggacttttttcctcttgtcagagaacgaagattccgctctaaagcatgtttgaattcactatcagtataatcttggatttccactaggctaccatccgtttttcagatatctctaacatacgttcaattccatccaaatagccgctatatctctctatttcatcaaaagtttcaactagatagatattcgtatgaatcaaatcagaaagatcatcactcattaaaatccaaggattagattcatcatcaatgctaattccctgactatcttgataacgatagagtcgtgataatagattagctcctctttctttcacaatttcaatttttaaagtcaattcataatcttcaacaggattgagcattttatcttctcctacaatatcgacataagatacattaaacttctgacaaatgatatctattagttccgtagagactggactagttccattttcataacgactcaagctattgcgagaaattcctataatttgggcaaattcgggttgtgttaagtcatgtgttttacgtaaggattttatgttctttccaatcatggcaaactcctttatttttataaatccattatagcataaaaaagcaaaacgcaccaaaaatggtgcgttatttcttgtttttctagcctaaactttacttctataaaagccaccttaaagagtaattcctttttcggtggcttttcaaaatactatacattaaaatactcttgtttaatttttgtaagcaaattgttagcaacagaagttacaccaacatgcatccgttcaggatcagaataatctagattacgagcatagacttctgtaacagtctgagcaatacgctcatccaatttataattggaggcttttaatagtgcacaaaataattctgaactatgttaaaggagaacaatattcaactgttctccaaaataattttattaaaaagaaaaaccctgccaaattaatttttggtagggtttttggtaggaaactaaatttatttatcagtttctaaaatgtgttcacgattctaaaaggctgatactatagtattccgaattctaattggtatatgcctcttatttaagagtaactgaagctccagcttcttccaatttagctttgatttcttcagcttctgcagttgcaacgccttctttaacaagtgctggtgcaccgtcaacaagttctttagcttctttaagaccaagacctgtgatttcacgtacaactttaataacgccaacttttttgtcacctgcagatgtcaattcaacgtcgaatgaatctttagcagcaccagcgtcagcagcaccagctgcagcaacagctacaggagcggctgcagttacaccaaattcttcttcgatagcttttacaaggtcgttcaattcaaggattgaagcttctttaatttcagcaataatgttttcaatgttcaatgccattgttatttcctccaaatatgttttaaatttataatagattttcgtagctaagctacgctgcgtagcttaagattaagctgcgtcttctttgttgtctgcaaccgctttgactgcaagagcaacgttgcgcactggcgcttgaagtacagaaaggagcatagaaagaagtccttcgcggtttggaagagttgcaagagcaagaatctcttctttagatgcgacagcgccttcgattgcaccacctttgatttcaagtgcttcagcgtttttagaaaagtcgttcaagattttcgctggtgcgataacatcttcgttagaaaatgctactgcagatggtccaacaaatactgatgcaagatcttcaagaccagctttttcagctgcacgacgcaagattgagtttttaatgactttatactcaacttcgtttccacgaagctcacgacgaagaactgtatcttgctcaactgtcaaaccacgagcgtctacaacgacgatagatgcagcagctttcattttctcagctactacgtcaactagttccgctttcttagcaataattgcttcactcattagtgtgttcacctccgtaattattttgcttgggaaatttttccaaaagaaaaacgcgcccaaacctagacacgaaagtacaatacgcttctttttacatgatacgttttgtcctcggtaggatacttatgagtcgagctcccctactgtcttaggcagttttttcaaaccgtatataagtatagcatagtcaaaaaaagaatgcaagatttttgcaaactttttttaaaattttttcgtgatttttcttttaaagttctactgtcaggacttgaccttgcttaactactggttctccagcaatataaacatcatcaacatcactggatttgactgcatagacaagatgagagagcatatttgcctgaggttggagatggattttcccttgtggttggatgaccagaaaatctgcttgcttgccaacttccagacttcctatctgttcgtccattccaagaaccttagcaccttctatcgttagagctttgagggctgtttcgattggaaactggctggcatccccacttttcattttctgtaagagagctgctgttcgtccttcctcaaacatatcaaggttgttgttggaagcaactgaatctgtcgcaattcccacagccactcccgctttttggagctggataattggagcaattcctgatgccagtttgaggttactgataggattgtgggcaatagccacttgagaggatgccaagcgctcaatttctcgctcgtttaattctaccccgtgagcaaagacagacggatagtctaagtaacccagttcttctagaaaggcgaggggacgtttgccgtatcgtttcaggataatgccagattcctccttagtctccgcaacatgaatatggataggaatattcaactcttttgccatatctaagctttcttccagcaagtctctactgcaactgtagggagagtgtggggctaccataaccttgaaatttggatttttatatcctaaaatttcctcaatgatagctcgtgttctagcaatggtctcagcagttgtctccgcctcagaagaaaaaagggtaggagaaaaataacaacgtatcttggaagatttcactgcctgataaatccgctcaatatccacaccattgggattatacatatcgttaaaggttgttgttcctgactggagcatttctgtcagcgcttctttgaccgccttggtagtcatgtctggagtaaactcagcttctgcaggccaaatataatcattgagccattcatggagattgctatcatctcgaatccctctcaagcctgtcatagcagaatgggtgtggcaattgaccaatccaggcataatccaagctccctgatagtctataatctgctcagcttgttctaaaatcttttgcttctcttgacctacatagacgatttgagaatccttaacggctaagattccatctagatagacatggaaatcttggttacaagtcacgatatttacatgctgatagactttcattctaggctccttttctaaaagacaatttatactctcttcaaacctctgcagattcaccttgccgtagatatatgttactgacttcgtcagtcttatctacaacctcaaaacagtgttttgagcaacctatggctagcttccttgtttgctctttgattttcattgagtattacagtgaataatttttctagctattgtaacaaaaaagtcacccgaaggcaacttttttcgtccataaaatttcaaaagagaaaggattattcagagctaaaagatgcagcttgctgcatttggtaatacttaccctttctagctatgagatcctgatgattcccatactcaacaatgtcgccatccactaagactagaatcatatccgcatcctgaatggttgacaagcggtgggcaatgataaagcttgtacgtcccttcatgagtttggcaaaggcatcctgtaccagcacttctgtccgcgtatcaatggaggacgtcgcctcgtctaagataagaatcttgggaatagctagaaaaactcgggctatggtcaagagctgagcctgaccgacagagagagattctccagcattttccaacttggtatcgtaaccctgcggcaactgttggatgaaaaagtctgcattggctgctttggcagcagcaatcacttgctcccgactggcatcaggatttccaaaggcaatattgtcatgaatggtcccttgcttgagccaggtttcttggagcaccatgccaaactgctgacgtaaagaggcacgactatagtcataaatggatttcccatccagcaagatatctcccgagttaatgggataaaaacgcatgaggagattgataagggttgattttccagcacctgtcggaccaacaatagccaccttgctaccagctggaatatcaatagataaatccttaatcaaaatcttttcaggatggtaaccaaaagagacatgtttaaaggaaatagctcctttaacttggtcactggtcaagacttccttaccagtttcagccagctcagtgctatctaagacagcatagacacgctctgcgcaagcaagagcactttgcaattcggctagaactgaggaaatatcgttaaagggcttagtgtactgttggacataattcaaaaaagtcactaaacgcccgatagtcaaggtagagcctatcattatacgataagctcccactccagctagaagcgcataaatgagcgcatttacaaagcgagtcgaaggattaactgttgaagaataaaagatagctgactgagaataacctgcataattggcattagcctcgtgcagcctttggataaactcttcctgagcattaaaggactggataatggtctgctggctcaacgattcttcaattaattgtgtctgaatccccctcgtctctgtttgcttctggaagagatgataggatctcttggcaataaagcgtgaaattaccatagacagtggcgtcaacagcaagaccaaaagagtcatgaggagatgaatttgaatcatggctagaatgctgactaaaatcatcaagacaccaataaaaaattggttaaatatcatggtcaaaccagctgccaactgctcgatgtctgtggtcacacgactgaccatctctccacttccttgacgatccacaaaagcaatcggtaaccgatgaagcttatgtatgattcgctctcgcaagtctctggtataagagaagattaggcgattataaataagaggatttatccattgtaccagtgtatttcctatgactaccaaaatcatctgtaggaaaatctgccaaaaaactggtgaagagccagtcactaggacttggtcgatgacctgtccgattaagattggtaggtaaatcgacaaaccaacctgagcaatagttcctagaaaggctaggaaaaggaggaagggatggcttgctaaatcttttgccaaacgtttgagcgtctggtttgcagtttgtcgtctcatactagtcctccttaccatgttgggatgcattgatttcgcgataaacttgactggatttcatcaagtcctcgtgattgccgatagctaggagctcacctttttccaagaggagaatctggtctgccatctgaagcgtcgaagtccgttgagaaatcaaaattaagctcgtgtttggtaagttctctcgaatagctttcaagagtttggactcggtaatggtgtcgagagctgaggtcgcatcatctaggatgagaaatgaagcttggcgcaagactgctcgtgcgatagacagcctttgtttttgaccgcccgagaaatttcgccctccttcctcaactagggcatccaagagtccttccttttcactgacaaaatcctttgcttgcgcaatttccaaggcctgccagagttcttggtcagatagttcttgatctaaacctatagtcaagttggaacgaatggttcctttaaagagttcgactttttggggcacataggcaatccaagaccgccactgcttcaaattaagaggactacctccatctcgataaaggtcaatgctccccttgtctgctggataaagtccaaggatgagttgcaccaaacttgatttaccagaacccgttcccccaatgataccaaggatttgcccttgcttcatatcaaaggaaatgtctctcagagaaggctgggccgcatcaggataggtaaaggtcaggtcttgaacttgtaaaacctgatcacttgtagcttgcttttgttctaattctgaatggaggtcttctggagcttcggcaaagacttcctcaattcgcttagctgagatataggactggttgagagaatttatcagcatggctagcttgaccaattccaccaaaatctgtaagagatagttgataagggcaatgagagtaccttgactgagcaatcctccttgaatagaaacatatcccttccagataataataaggagagttccatttacaatcagataggtcagaggtgttaataagctagaccagaaacctgttttttcttgcaatctggcataaacttggttaagggtctgaaaaatctgtaactctcgtctttcttgtccaaaagcccgaataacccgcatcccttgtaattgctggcgcgtttcttgaactagttgatctgttttctttctgagactactgtagagaggattaaccagtttagaaagcactacaataacaatggtcaaaatgacaaccatgaccaagaaccagaaagtcagctcagctgagatgcgataagccataaaaatggcaccaaaaacgataataggcgctcgcaaaaagagacgcaggaattgattgataccagtctgaatctggtaagtgtccgaagtcaagcgagtgatcaagctagaagttgtcaaacggtctctgctgtccttaggtaaagacaaaatatgacgataaagatcgtttgtcaattccttggcaaaacctaccgctgcattagctgagtaaaactgggctattaaggccactacaacaccaattactgcaaagctaaggagcaggccaatctgcatccatagatgaccttgatttctttggggcaaggattggtcaacaatcccagcaatcaccatgggaaccaagagttcaaaaacagcttctagcagcttgaacaagggagccaaaattgattctttgatatagggtttaaagtaagatagtaagtgtttcataaatcccttctattcgttttctagaaatgaagaaagtgggaagcacccaccatctctgatttatttgtttaagtaaggtagtagatagccatatccttcctcttccatctcatccttggatacaaaacgcaaggatgcagaattaatacagtaacgcaggccacctaactcctgaggaccatctgtgaaaacatgacccaagtgagcatttcctgaccgagaacgaacctcgattcgctccattccatgactcatgtccttgtaatagtgaatcaactctttggaaatcggacggctgaaacttggccaaccacaacctgaggcaaacttatccttggcaaaaaagagtggctcacccgttgtaatatctacataaatcccttcttcaaaggtttgggcataggcattggtaaatggagtctctgtagcagcttcttgggtaacacgataggattcttctgataagctttcctttaaaacctcttggctaggcttttcatagtttgctgcatcaatcaatggcttctcagcatcggtcacatcgatatgacagtaacctgaaggattcttcttaagatagtcttggtggtaatcttcagccagaatgtaatgacgtagtttctccacctctactgcaatctttcgcccaagcatgcgctcctgctcctgcaccactgtgtagatagctggcaaatcagcttcatcttggtaataaattccggtccgatattggcgaccacggtcattcccttgttgattgatagataaagggtcgatgacacggaaataataaagcaaaatctctctgagtgacactgctttctcatcgtaaatcacttgaactgtttctgcatggtctgtttccttgagcagctggtaattggtcgtttcgacttgtccattagcatagccaacactggttgctagcactccagaaatgcgtgaaaaatactcctctagaccccaaaaacaaccacctgctagataaatttctgccatctttatttctcctttatcaagtctttaactaatactcttcgaaaatctcttcaaaccacgtcagcttccatctgcaacctcaaaacagtgtttgagtatcctacggatagcttcctagtttgttctttgattttcattgagtataaacttcttttcaaaaaaaggataggaagccctctggtcgagagtttccccatcctatcttctattctttattttgcttcgacacgaacaccttgggtatcaaccttcaagtcatgcagttttcctttgaagggttgcttttccaattctgccttaatcgttggcatcttgtcatgagaagccaagaccataactgtcggcccagcaccagagaggtaggttgcataggcaccattttctttggctacttgcttaatcgtcgcaaattctctcaccaagtcctgacgatagcgctcgtggaagaggtctccctcgattgcttgcccagcagtcgccatgtctcctgccaacaaggccgcaaccgccacattggcgatagaactagctgcaacagcttccttgtaagacaattttttaggcaagacaccacggctgtctcgagtacgcaattcatagttgggaatgtaggctaggaaatcacactctggaaagtctgctacgatagcagaaacttgcccttcaacagagcttgcaataacgagattaccataaatggctggagccacattgtctggatgtccttcaatcttggttgctaactgtaatttttcatgatcagacaagttgagctgacccagttggttggctagttcaatcccagcaacaataaccgagctagaagaacccaaaccacgcgccaagggaacatcactggtcattttcaggcgtctaggtttcaaatctggtacaatttgcaaggcgattttgagcaagagattacgctcgtcatgtggaatccatttgccaatctggtgttcaatcagccactcatcccgttcttcacagacctctatttgaagatacttggttacagctacaccgaccgagtcaaaacctggcccgatattggcactggttgcaggtacaataatcttcatcttattctcctagcaccttgaaggtattcaagaggtcgaattctgaaaccttcttcaattcagctgagacattttcaagctgggctttattaatcttgtgtgtgatgatcacaacacgcgccttatcaccttctttgccatcttggaggatttgcttgaaggaaatatcttgagcgttgaagatttcagccaatttcaagacctgaccttttgagtctggagccaagattgagaagtagtaatttgctttaacgtcttcaggattagccaagaccaagtcacggctatattcgttgaagtctttgccaatggtaccatcattcaagcgacgaacgatacggacaatatccgccacaacacttgttgcagttggtttttgaccagcacctggtccgtagtacatagactcaccaataccgatagattctacaaagacagcattcattactccattcacactggcaagtggatgcgctttaggaaggaaggttggagtcacttctgcagcaattcctgaaggagtttcctcaatagaaccaaccaatttcactacataaccaagctcttgagctacagctacatcttctggtgtgatgttacgaattcccttgtgggctacgtcatcgaaggcaaccttcatgccaaaggcaaattggctcaaaatcaccatcttgtaggctgcatcaatcccatctacgtcatttgtagggtcactttctgcaaatccaagtctttgtgcttctgcaagagcatcatcgtaagaccagccttcttcgaccatcttggtcatcatgaagttggaagttccgttgaccacgccaagcacgcgcgtgattttatcagaagccaaggaatttgctagagtgcgaagaattggaatcccaccagctactgctgcttcgtagtaaagtgctaccttgttagctttagcaatttctagcaattctgcgccatggacagccaaaaggtccttgttagcagtaacaacgtgtttcccagcttccaaggcacgagtgataaaggtcttagcaggttcgatacgccccatcaattccactacgatcgtaatgtcttggtctgacaaaatatcatccacatttgttacaaagttaaagtcattccctgctgcaagcaagcgattcttttcatcttcatccttaaccaataccttagcaacttcaatctctgaatgtgctgattgattgattttttctccattttcctttaggaggaaaggcacgccacttgcaacggtaccaaatcctagtaaagcaattttaactgtcatgtttgtctccttgaaattttctaatatagccattataacagaattttgtgaaaattcctattatagtaattcactatttcagtctagaaaagaaaaaacgaatcatatgattcgctcttcttaaaatctagaaatagctttccagaaaggattatccaatcttttgcagattgagcactgcatcgtgattcagcaagacttggccatactcttgcaagactgaacgactgatatcactatcttccgcaaactcgcgcatacgggccaagagccaagctggatatggacttggatgattttcaatatccactaaaatggtcaaataatagcgctcattcatcttgtagagttcagaagtttccatctcaaaagtcactgtcttggcaaaagccaccaagtcagctaacttagaaaaagaaaggatgtaatagatgtacggctctttcttgctttcaccttcttgttcagcctgctcttgctcttcctccttggcttcaacctgctctagagattgaatcgcttcgatatcatccttggttttgtctgcgatgcttttttccaaggttttgataaattcatctggagacatttgagccaattcttccatatctggtaaatccgataaatcttcaaaatctagattttgatcaatctttgatttggttacaaagacatctaccttatcaggttttggagtcacacggaagctcaacatacctgtatctaggaagctatcaggcatctctaactcatccaagatagcataaaagaactcttctgttttttcttgaggaacgagaaagtcagcaatctccattcctcgatccatcaaatcctctaaagacatcgtgatttttaaagttgtatcactgatttgtttcattttcattgctagtaacctcatactttcagttctatctattatactagatttttacgattttatcaaaagaaggctcctttgtcgatatagattttccatagggtaacttctgtagaagaccctaatactcttcgaaaatctctgcaaacaaatagaaaaagccttcaaaatcggctcttagccaactttgaagacctaatacatcagaaagcttatagtttaaaggttgctacaccgaggatagaacgatttaagtttcgaagaatttgaagactttgttcaaatttcttataacgagtcactccgtattcttcaacaagaaggactgtatctctttctaaaagagatggtacatcttgtaaatctacaaaatgcattcctttcaaagcctcttgattttgttttaatttatccagaatagctttatttgagctaacgatagtcaattcttgtccagcatttttgtatgatagaatatctgctagattagcaattgttgtaatctctgttacaaaatcaatttgatactgagaaaaatcacctgctctattgattgttgggttaaagagataaaccaatacatttcccatcacaaccaaaatcacacaaactactccaataacagctagacgaagaatcagattcttgacgtttaatccaagcgctgtctcaccgtttgcgttcaattctttagagttgatggtttccaatttttcaattttcacgtttgcataggtatttttaaatttatcaaccagtgcatcgatctttttctctaacaagtcgttggcatctttacttggtgtcaaaattttcacactaacccctgcatcgtcaatcatatagtagacagtcaattttttccaccaatagtcacttgtagaatttttcaaggttgtctctgtcgtatccaattcactggcaatttttttcaactcactaggctctacatcattgaaaagataagctccattcaaattcccatcaatcaattttccgtagaaatcactataaccaccaatttgatgattcaaaatcgttttagctgaatcttctggaggtgtgattttatagctgatataagttgaataacttgttgtgtctttgacagtatttttattcttaactgctttaattgtaaatggtacagcaatgagagcaaataaagcgatgagagctagaatatttgcttttcgttttttgtatagatttgcaaacaaatcagctactgaataatgttcaaacatgatttttttctcctttgtttagtagatactggttctcttttgtaagcattttcgctacgaatataatcacaagaacaattccccagaattgcattgtaaataaattgaagaaactttctgaaaagctacttcttggcataaagaatagattattcaaaatgagtagggacaaggcaaataagattgttcttgaacgataggctacttgcaacatggctatgaatagcatacctagcaagagactaagtagaaagactcctatcataccatagtcggtatacaactccataatgtagctacttccgataccatgtcctttcaagtattccttgttcaagacaagataggatagattatgggcataactattactatcaatagctagttccacactattggttgtatgttcaaaggcttttcctccgaaaatggcccctaaacttccccttgcaaaataatcaataacaggaccaaaagtaaaattgcgtaaatctcggtaaggtaggctactgttaaatagaaaacctcgagccaaaacaccaaaactggttccttgtttatagataaagtcaagcaggatatcccagaaacctgtatgggaaacctggacattatcccgtacataattgagtattcccatcgctaacatgagaataggagaacctacaaaaatcgctaacttttctttaaatccaatccattttcccttttctgtttgctcccgcataaagtaataaacaaaagcaaatagaatacttaaaataaagggatttcgtgtcccgattgccaaatgaatggtattggctgcaataaaggagacaagcactgctgttgcctgcaatttctttggcttggttgccaaatacatacacattgcatagaccgtaaatgttgataagatataggtaaaatagggcagtttactttcaaaatttgcatagtaggcatagtaggaagtctgcaagcgatacaggagccgttcaaataagcgaatgaaatagaaaggataggttagaagaaaaactcctagcgatacaaagcgcaaccgcttgatgtaaacctcttttagagaacttcctatcttgggtacttgtattttctttctagctataaaatagcgagctaggagcccccctgtggtcaatcccaatatcgaaaccatgacgactataaaggcaaagcgataggctatgggatgataggtatccaaagcaccatccctaaagtaatcaatggtcggccttgataccagaaatacaaaaatagttaaaaagaaaataaaatggattaagtaatacttgatatcattccaacaagcaattaagctactaaccagtaagaacaataaagtagaaagcaagctaacattgttattattaaacagatacacaattccacttactatcgtcaaggcatagctgactatggtcaaactaaataataatcgttttccatcaatcacttactcacccccgttctaatgtaattttttagatttttcaatattttttagtaataagaatcggtataaggaaatatttatgaatagagccaaaacactaattcttctccccttacggaaaattggattcctagcaatagcaaaggcatggccttttaaaaaacgatgaatctgagaataggcttcaaattgtttatactgatcatctagcaacatcttatccagaataaagaagtgggcataggccaatctgaaaaaagcaacctctttcaagtcaggatagtttttcacaacttcattgtaaaacttttggtagatatcaatataggctaaatccttctctgcatagggtttagtcgtaatactatcccctctatggaaatagtaataatagggtttggtattaacaacgtacttcttggtcaacttgattaaatcaaaatgataataagcatcttcgtaaatcaatccctttggaaaggatagtgcagttgcaatctctctcttgattagcttattgcaaatcgtcccaggtattttttcacctatgaggtattccctcagaaatgtttgagaatcacagacaaaatagtcatcctgattggttgattgtgggctttcatcattagcatagacattcatgacaccacagctcgaaacatccgcatcttcttgaattaattgctcatataaactctgaatcatttctggatggatataatcatctgagtcaataaaaatcagataatccccgtgggcctgcttcattccatcatttcgtgcttgcgacaatccttcattctttttatgaagtactgacaccctgtcatcttgttcagcgattgaatcacacaagtgaccactctcatctgttgcaccatcatcaacaagaataatttccagattttgataggtctgctcctgaatggaagctatcgatttttctaggtactgcgccacattatagactggcacaatgacactaattaatgcagtttccatgctactcctctaatagtttttctacttgttcgatttgtttggcaattgtaaattgttgaatgaattggctagcctcattgacatcaaagtttgaggcagaggtcatgtagttcgtaattgcctgagctgcctcttgattgctctcaatgatttgtccaaatcgtccttcttgtgatagttcctcagcccctccgacatccgtagagacaaaaggaagtcccagactcaaggcttccacatacactccaggaaaaccttcttgtttagacatagacaagagaaccttcatctgagataaatactgataaggatttttttgataaccaaggaaatgtacatagtcttcaagctcatattctttaactcgttttttcagttcctcttccatatctccagccccgataaaatagagatgatagttttttccctcttggtgtaataatcgtatcacttccaccacacggtcagaacccttattttcctcaatccgtccgatagtacagatactttgaggcgcaatctcgatatcgatcttctcttgagatttttctaaaatagtcttaaaatcatatccattgtagactgtctgtaatttcgaagcataatctggatagacttccttgatagaattgctggttttattcgaaattcctacaatggtatccgcagcatccaactggcgtctatgtgactccctttttgagctatccttaagaaattcttcgatacttccatgaatccaagagattttcttgacttcttttcttttagagaacaacagtggaggattcataatagtaaaagaaacttcaacatcatagtcatctttcacaagcaaacgacgggtcagtcttggaaaataaattctcattctccacaaaagagctcgaatccatctggcttggcgataatcctgaaaggattttaaaatgcgtacatgcttgggaacagattcatatcccttatcaaaatgttccatttcaagaatatcaatatcatacttttctggatctagatttgaaacaatggtagatagaatcttctctgcgccacccccgagagaaaaagaccacataaaaaataatatttttttcttagccaccatattctcccttgtattctgtataagacttatccatatcagcgatgacagcatcatgatgtggtacttgcttgtctgctggtggaggtgtcatataatccccaaaagcagtgctgagataagcatcatagccgactggaacgggcatctctgtctcttcaaatggcaagaaaagattatcctcaaaagattcgattaggtacttgtttctcatgtaaccaggacccgagcataattccgtgattccatcgctctcagctagactgtacttggtcatttctttttcagcttttttccaaatacgataacggagagattttggagtcaaccccagtaaaatacggcttccccacttcataagtgcgccatgtttttctggaatagtttgcgcacaaaaaagagaataaatcaaggcccaacgaacctgttttttccgttcagctggattttcaggataataatccaaaggcaacacatccaaggccagaccatgtggcaattctaaatcctgctgataaggtttgatacaggtcgtttccttatcacgaatggtaataaaaagattgcggtcgacaaaatccttgttactcttcgacaagaaataacgttcatctgcataacgaggccataattctgccaatttttcataatccttacggggcataaaaaaatctagatcatcatcccaaggaataaaacccttgtttcgaagggcaccaatagcacctccaccacagagataacaaagcaaatcatgttctttacaaaaggccacaaaatattcagccatctccagacttcgagcctgaatagcttttaaatcagtcatattgttcattattctttctatcgtatcgttccattataccacaaataagggatgaaaatctattgcagactgtaaaaaatcaaagcctgactgctagatacatagccttcaaactttgatttttctatcttatctcattcccatttgagatagcttggtttgatatttattttggtctactaagagtgcctgtcctccatagacatcataggcatcgacccaatcacctagttctggaactgttaatctctcaataccattttgcgctccatctaggaaggataagccattggtcaataagaaactatagggaacattcgtagaggtcataccaaagaccttacctaatgcttctgatccagtaaagagtttagttggatccttgagttgttgcagaacagctgtcaacacttgctgttgtctcttggtacgaccgtaatcaccttcatcatcatcacggaagcgagcataatttagcaaggttgaaccgttcatctgctgtttcccaactttgatagtctgagttggtgactctgtttccgtagcatgtaaatcatctccgactgtagcttcggttaaaggttgaccttctaaggttgagaatttggcatcaatcgttacaccgtcagggaagagagtgtcaatagcagttgcgaaggcctggaaatctaccaaagcgtaatatttaatatccaagtcaaaattgtcttttaggacttttcgaaccatttctgcccctttttgcccctcttgttcccccaactcataggctacatttaacttattatcggactgctttctaccattaatgacttgactgtatccgtctatatagaccaaattgtcacgcataaagctggccagtttgatttttttatctgagccaccaacgtttagaaccataatcgagtccgttctcgtctcagcactgttttggccaatccgtccatccgtccccataatcaaaatattgaccccatccttggtatcttgaccatgaaaaacttctacttgagctgccttagcattggcaggtttggttggatccgcatttgaataaccttttaggaacataaaaatcataccaaaaccaacacaggctagaagagcaagcaatcctgcaaaaatgcgaccccaacgaatcttacgttttttggacttaacctttggatgagaatgagttttctggtatttttttgcacgactacggttaccataggatggaagaggagactgattgactggctccatgaaagactcttccatatcgtgattttcattataaatttctggtgaaacttcactaccactagccatatttaacttaccttgcaagtaagcaaactcctttttctctcgctcattgaggtaatgaatgttcttaaaaagatagtcataacgcaactgctcgtgatggcttaagggattttctttactcatcttctctcctttccatggtctgatattggataaatgggataggcacccagaactttatactggattccaatcgcttctaattctttttgggcaaagtggaccaagtccttatcagcatagtccacatcaataatgaaaaagtattctcccagcgctgtcttgagtggccgactttcaatttttgtcaggtcaattcctctccaagcaaaggtcgacagggccttataaagtgcacctggaaggttgtccggtaaggtcaaggccaaactcattttctcagtttgtgcttgcaagggaatggctgcaccttcagctcccaaaacccagaaacgtgtgaaattagcttccatttcttgaatatcttcagcaatcagttctaagctatattcttcagcagaacttcttggtgcaatggctgcataaggctggtctggatgttcggaaataaaacgggccgcataagctgtactagctgttacctcaatttgggcctctggatattgttcatcgatgaatttctttccttgagccaaagcctgaggatgagaaaaaatcttttcaatcttagtatgacctggaaccaccatcaactgctgatgaataggctgaacgatttctgccactgcttgaatgcgagcctgatgaaaaaggtagtccaaggtttcatgaacactaccctcgatagaattttcaactggcaccacagaatagtccactaatccttgctcataggccttgatgacatctgtaatgttggcaaaagcctgcaattcctcctgaggaaaagctgtctgcacaacgtggtgtgaaaatgatcccttgggacctagataagcaattttcatctcagttcctctataatttcctctgggcttagcttggtcacatccaaaatccgactagccacttcctcataccaagcctgtctttcttggaaaatagctgcaagttcttccttgctattatttagaaaaagcggacgctgattgtccttatcagctgcgatacggtggtagagggtttcaaaatcagttttcaggtagatattatcagaatttgtctttagtaagtcacgatttcgctgagaaataaccactcctccgccagttgacacaactttgtctctttgtagtaactcagctaggatttctgactctacctgacgaaaagattcttctcccttttccgagaaaaattccgcaatagacatgcctaagcgcttctctatcagagcatccatatcgagataagctggatccaagcctcttgcaatagtcgatttgccagctcccataaagcctaataacaccttagccatgaatcaagttctccaaatcatcaaagaagctaggatagctggtattgatggcttctgcacgatcaagctccacttctccttcagcaaccaagagggccgcgatagccgtcatcatgccgatacgatggtctccaaaagtattgactctagcactgttaagggctgattttcctttgataatcattccatctgccgtaggagtaatatctgctcccatactatttaaggcgtctgccacaacctgaatgcggtctgtttccttgaccttgagttcctcagcatccttaataactgttacaccttgagcttgggtcgcaagtagagcgataatgggcaattcatcaatcaagcgtggaatcaaagcgccaccaatctctgttcctttcaagtcagaagactcaacagtcagggttgcagatttagcgactgggtcaatttcagtaacttctaattttccacccatggcgcgaatgacatcaatgatacctgtacgcgtttcgttgatgcccacatttttaagcaccacacgagagtttggaacaatcaaacctgcgaccaaccaaaaggctgcactggaaatatctcctggtacgaccaccttctgtcctgtcaatttttgtggcccttggactgtgattttcttaccgtccacacttaaatgaccaccaaattgttgcaacatatcttcagtatgattacgggtgcattctttttcgataatcactgactccccctgagcttgcaaggccgcaaacatcaaggctgacttcacttgagcagaggcaattggcaattcataatgaataggtcttaggtttttcgtcccttttaaatgaaggggaggcaggtctcgctcagtttgccctgaaatactgacacccatttttttcagtggaatagtcacgcggtccataggacgtttggaaagactatcatctccaaacatttctacttcaaagtctgcaccagcaagaacacctgaaatcaggcgaatcgaggttccagaatttcccatatcaagggcattttgcggagcttttaaaccatccatacctacaccttgaatggtaataacctcatctttatcctcaatctcaacaccaaggtcacgaaagacttgcatggtcgaaagaacgtcttcacctcgcagaatatcataaaccttggtctcaccctcagccaaacttccaaagataatagaacggtgactgatagacttgtcacctggaactcggatactgccatgtaagtggctaatgtttgtttttagtttcatactggacctcatacttgcaatacttttacctattttatcataaaaagccagaaattccttaaaaattcctgactttatgatagttattttcttattttagcaattctgaaactggttcgaaaacaattttttcaatgtcagaaaggtaaattgccaattgttgttgcttggtaaagaattctgacaagaggctattcccttgaatctgcttgccaaagccttccattttcgcttgaaaggaagcgtctggcatttgacctgtctgtgctagtctttgaatttcctcttggaaagcaacatattctgtaaaaattttgcttgcctcagcatctgctgcaatcgcatctttagctgctttgacagccttgtattctggtaattcgcgtagaccgcgactgagttcatttgcactatcgtaaatatttgacatgattttctccttatttaatgacgactgtgtagtcggtattttctgttatgagatgctcagctcgttccaagtcttgagcatttttaaatgaaatttgtagaatcccgtgaatatcttcacggttttcctcattgatgtgaatattgaccaaggaagttccacgtagtagttccaaaatcctcaagatgacatcttcttcatcaggaacatctacataaaggtcataagagctatccacaccgccacgcttatggatttccatagcctgacgttgctcacgcgcttggttgaaaaagttccaaatctgctcttcatctcccttgctaatggcttgtccaacctcatccaaacgttccttaaaatcctcaatccgctctaggatagtctcacgattagacaagagaatagaggtccacatacctggttcgctttccgcaatccgagtcatatctcgaaaaccaccggccgcaaaacgccttgccatctcatgttcttgagcatagactgccgtctgctccatgagactagaggctataatatgagggaaatggctgatctgagaagttacccgatcatgctccttggcatcaatctcgataaaacgggcatgaagacctgaaagcaagtccctcatttcctcaagcgtgtcctgacctgtcagactcgaaggtgtaaagatataataggcattttcaaaaagattgacatccgcagaagcagcccccgtcttatgactaccagccatgggatgggccccgacaaagcgaacaggtttgcaagccaaatattgctccgccgcatccacaatggctgacttggtcgaaccagcatctgatataatcacgccttctttcaagtccaagttagccaattccttaatgaaagcaatagtttgtttgattggcaagctgagaataataatatccgcaagaggagcaaaactggcaaaatcatctgttgcacggtcaatcatgccctctttcaaggcgacatctctcgaagcttgactgcgattataacctacaatttcataatctggatgatcgcgtttgatcccgagtgccatagaggcaccaatcagaccaaggcctgcgatatagactgtttttgccataggaactccttaatagttctttgcatactctcgatgtttggataccgcttcttttaattcctctagattgtctgatgagaatttttcaaggatttcttgtgccagaaccgttgccacaacagcttccatgaccactcctgcagctggaagagcagtcggatcacttctctccacagttgccttgtagggttcatgggtttcgatatccacactcatgagtggtttgtagagagtaggaatgggtttcatcacgccacgaacaacgatgggttgcccattggtcataccaccttcaaagccccctagattgttggtacgacgagtatagccgtcttctttagaccagagaatttcatccataacttggctacctttgcggtaaccagcttcaaatccaaggccaaattccacccctttaaaggcattgatagagacaactgcttgggcaagtctggcatctaattttctgtcccattggacataggaaccaagaccaactggaacacctccaacgactgtctccacaaccccaccgatggtatcaccgtcacgtttgatttggtcaatataatccttgatttcctgttccctttcttggttgacaatagaaacttcagactgggcagctctttccttaatctcagcaactgtcagattctcaggaacatcgatttccttgccaccaaagaccacgacatggttagccatttccatatccagctcagccaagatgcgtttggctactgccccaactgccacccgcatggtggtttcacgagcagatgagcgctccaaggaattacgcaaatcatcaaaacggtacttgatgcccccaaccaagtcggcatgacctggacgtggatgggtgattttccgtttgcttttaaggcggtcttcaatgtcctccgcagacatgatatccagccatttttgatggtccttattgacgacatccatggtaatgggagccccagtagtcctcccatggcgaacacccgaagtaaagataacttggtcgctctcaatcttcatacgaccaccgcggccgtatccaccctgacgacgtttcaaatcctcattgatatcctcagctgtcaaaggaagtccagctggaattccctcaatgatagctgtcagacgggggccgtgtgattctcctgcagttaaatatctcatacactctccttattttaccaagtagtctttcatctcttccagagaaactgggtgaatagtcgctgaaccaagctctggtaccaagaccaatttcaaggtattgccacgtgctttcttatcatgagtcaaagcctgataaagcttgtcaacatcccagttttcataatcaacaggcaagccaaatttctgacacatctctataatagactgggttattccttctggcatgagacctttttcctcagcaaccttggaaatctgtaccatacccatagccacagcttctccatgcatgactttcccataaccagccgttgcttcaatggcatgaccaatagtatggccaaagttgaggtaaaggcgtacaccattgtccagctcatcctcaaccaccatcttgcgcttgacctgacaagaatgttcaatcaagatctctgcatgctccagaatgctctcaacagaaccatccagctccgtcaaaattttccacagttctggatcctcaatcaagccatatttgataacttcacccatcccttcaatcaactctctttttccaagcgtttcaaggacaagtggatcaatcagaaccccatctggctgggcaaatgtccccaccatatttttagcaaatggagtgttgacacctgtctttccgccgatagaagaatccacctgagctgtcaagctggtcggaatctgaacaaaatgaatgccccgcatataggtagaggctacaaaaccagccaggtccccaacgacaccgccaccaagagccacgattccatcgctacgagtcaacccctgcttaactaggaattcatagactttctgaacagtagttaaattctttctttcttccccttctaaaaagtcaaaaactgctacctgaaaaccagcatcttctaggctgagcttgaccttctctgcataaagagaagctacatggttgtctgttacaatgactactttttgaggttgccagagctctcgcaaccattgaccagcctgagccagacagcctttttcaatctgaatatcataaggatggtgaggaatatcgattctgattttcataggagaatctccctttctttattggtatttttctgttaaagactgccaaatctcttccgttggcatttcctttcctgtccacagttgaaaagcttctgcagcttgatagagcaacattcccagaccattgactgctggattgccctgacttctggcccatttcaaaaatggtgtttcaaagggtttgtaaatgatatctgctactaagagagtttctgataggacaatgttttcaggaactggagatgattgaccatccatgcccacactggtcgcattgacaagtaaatccgactcagcaatccttgcttgcagttcagaaacatcttctaaagcatacaagtccactttaaagcctgtctgctcctgtaacttgttcaggtaaggtcttgtttttttcatagaaactgaacgaacaaagacagaaatctgactgacaccatccaaaatagcctgtgccaagattgatttagccgcaccacctgcacccagcagggtcatcttcttacctgaaattgtaaaagaaggcaagctcttaaaaaatcccttgccatctgtattatatccaattaaattgccattctcattgacaaccgtattaaccgcaccaatcaagcgcgcttcatcgctcagctcatccaaataagaaatcacttgctccttatagggcatagaaaggttaattccaaacatctggtagcgacgaatattggccactgtttctgccaagtcacccgcttcaatctcccaagccacgtaagcaccattggtatctgtcgcctcaaaggcactattgtgaataaagggggaaatagaatgcttaataggattagcaacaacggcagctaaacgtgtatagccatcaagcttcatccaaaatctcccgaatttttttcatgttagctaaggaaatctgacctggggcacttgcctcatctagactagcaaaagaccagctagaacccgtcacatccgcagtgatacgagagaccttgcccaccttgcccatagaaatggtcacatattcctgctcaggattgaggattttaaagcctcgtgtatagttcatcaagtctagcacatcctgctccgtgtgagccatcaccgcaaccttaacaagttttggatttaagctcgtcaactctgacaagatttccatcatattttcaggtgtttcttggaaattatggtaactcaaaacgagatttgggaagtccagcatttcctcaaaaacatccttgtagctatagtactcaaaatcaatatagtctggttgatagagttgtgccacttccttgattagatggatatattcttctggagaaaggtcgatttctcccccttcagagcgagttcgcaacgtgaaaactaactcacggccagcgaatttttcaaaaatagctggagccacctgcaaaatcgcttccttaggcagatagtcggcacgccattcaatgatgtcggcatctaggtacctcgtgacatccagagcctggacctcctctaaacttcttggcattactgaaacaattaatttcatttactaaccttcatactaatcaccttgaggtaattactactttcatcttttttattataggcaaaatctgctggaagaccgtatttatttaaaatctggtaacttcttcctgcaaagcctttatcaatttgttctgtaaatttctggcgggatacattggcagcattggtgctggcaataataataccgcccggatttaaaatctcaagactttgggatatcaacttatgataatccttagccacagaaaatgtttgttttttgttccgagcaaagctaggcggatctaggacaatcacatcataggtcaagccttttcgcttggcatacttgaaatactcaaaaacatccataactataaaacgatggtcgtctgtgctgattccattagcctgaaaatgcacttgagacaattctcgtgaacgtttagctaggtcaaccgaagtagtctggcttgctcctcccatggccgcagccactgaaaaggctgctgtgtaggaaaacatattgagcaaggatttacccatagccaatccatccactaaactaccgcgaacttcatgctggtctaggaaaatccctgtcatcaagccatcgttcataaagacttgatacagaacaccattttccaaaacagtgaaaaagtcaggtgcttcttgaccataaacatgggcagattcatagtccaaacccttaaaacggatcttctcatatgctcctaacacctcaggaaaaacctgtctaaaagcttctgagatggtctgacgaatctgataaacataagagttataccaagaaaagacagcatagtcgccataaaggtccactgtcagacctccaaagccatctccctcttggttgaagagacgaaaggcagtagtcaaatcatcttgatagtaggcacttctcttttctttagcttgtctaaacagtgcttcaaagaaagcttgattgaaggtcaccttgtctgtgctgacaaaccagcccaagcctttgttttgctgagaaaggtaggcagtcccaagaaaggttccttcctgactctgcacttctacttcctgatccttgagattgatattctcaagatcgctggcttctagtaaaactagtccctttgaaagctttttttcaacccttttgttgactcttattctattcatagtcactattatagcaaattttgtgacaattctcaaaaaagaaactacccttgcttttttactctagttttaaaaaatggtatactaatactaataaaaacttaggaagtaattgtgtgagaatcaattttaacaaaatccaaaaagccatgggtaccagactgggttttgtcctaacccttttaatcctctattggctcaaaaccttactagcctataccgttgactttaatttagatattcaattgggcaagctgcaagggaattaccttgcctttatcgcttttttcaatccccttcctttgggactcctcctgctggctctagccctctatgctcggtcaaccaagatcttttatggccttagtatagctatttatagccttttgttcatttggctttattccaatatcttttactatcgagaatttagtgactttatcacggccaataccatgaaagtggtcagcaaggtgtctgttggtactgccgaactagagttactacgcttttgggatttcatctattttatggatttcccattgctggcttatcttctctataagaagctcatccagttggataggagacctttcaaattccgctccagtgttgctatcacagctctctcagccctgctcttttctgctaatcttttcttggctgaaatcgaacgtcccgatctcctatcgcgaggattttcgaattattatgttgtccgcgccctcagtttgccagcctttttaggctatagtgccaaccaatcatacagcgcaaacaaagaacgtgctaaggcttctgagactgatcttcaacctattacagattatattcaagaacattctgctaagcccaatccagactattttggcttggccaaaggaaaaaatgtgatttatctccacttggagagcttccagcaatttcttcttgactataaactcaacatagatggaactgagcatgaagtcactcccttccttaattccctctaccattcgcaagcaaccctagccttttcgaatatctttaaccaagtcaaggctggtaaaacctcagatgcggaaaccatgctagagaccggtttgtttggacttgaccaaggttctttcatggtcaattacggtggtaccaatacccagcaggctgctccttttatcctatcaaaaaacggctatcaatcgagtgccgtctttcacggtaatatcgggaccttctggaatcggaatacgacctataaacaatggggctaccaatacttctttgatgcttcctattttaccaagcaagacagtagcaattctttccaatatggtttgaatgataaaatcatgatgaaagattctatccaatatctggagcatttgcagcagcctttttatgccaagtatatcacggtgtccaatcactatccctatgctagcaatctgactggcgatgagcttggtttccccttggccaaaaccaaagacgaaacgatcaacggctacttccaaacagccaactatctggatagtgctatcaaggccttctttgactatctcaaagaaagcggcctctatgaaaaatccatcatcgtcatctacggagaccattatggaatttctaactcccgcaatcctgacctcgctcccttgattggcaagacttctgaaaactggtcgaattacgacaatgccatgttgcaacgagtgccttttatggtagtcatgcctggctataaaaaagggcaaatcattaatacctacggtggacaaatcgatatcttaccgactctcgaacacctccttggtattaagtccaattccttccttcaagttggacaagacctcctgtctccagatcatcaagaaatcattgcctttcgaactgccaattccttcgtcacaccaaaatacaccagttatgacggacgaacctactacactgagagcggtcttgaaatcagcaatcttgatgaacaagctcagactgaactagaaattgttcgtcaagcagctagtcaacagctaaaaatcagcgaccagattcaaactggtgatttgatacgtttctaccaagcagatcatcttggaaaagttgatacagaaagtatttcttacctcaattccttgccaattctgcaaaagattgaacaggaaaaaggaagtcagtcaactagcctctttagccaacgacaaagtaagaccagtgctgaccttttcaaggcaccaagttaccaagaactccatccagagtcggcagaaaccgaatcaaaatcacaataaaaatgctcttccgtcttggaggagcatttctttttataaaatttatcaagtaagcgacaaactacctcatcttttttctatttctgctaatatgcgtgacaggtagtaatgatagctaaatatagcaagaccaagcagaaggataagaactcctactcccaagctgatggcaaagatagtggagagagactgaaccaagaataagctccctattacaagggccattaggattgcactataaaccaaaatcaaaacaattgctactatacgatttgaacggtttaccaagtccgtaatgttactccaattggttgacagattcttcacatccttaaaataatggtgacaagaaaggatgacactggcaagggtccagactacaagaaggtaaatcatcgaaaggatgggcaagcctaaatatagagaaagaccaagtaaagtcagaactggtaaaaaggactggacagcaaatataatccaaaatttcacttttacataacgagcaaagtcaaagggtaaactcttcagaaaatcaacattttccctctccaaggataaggcaattgaatgcaggctggtgatattgttattgacaacagctagaaagagacctataaaaaacaagggtaaccagtatggaggatgaatgtctggaactatctgagaatctcggatgttggaaatcagaccgatcatcatgagataaggaaggaaagcacttgtaaaaagcactgtaatcacgccagtcccctgtcccaaaagggtgaggtggtagcgtaaaaccatacggaaaaagccctttttagtagttgagagcccctccttactgcgacgttcttttatgaccttctcctcactgttaagtaggatcacgtcataaaaatgaggaagaactttctttttggtcaggtaaagcaagaaaacagttagaattatccaagcgagcagacccaggatggcttctgttgaaaaaggctccactgctattttgtaaaagagatgaataggataaagaagaggtggaatgtctctaactctgtcaactataactccagaagtcgactgtagaaagaagacaaatattaaaggtatgagaactcctatcccaatcatcacattcgaaaaaatagactgatactttctgaagaccgtagtctgagccaagaaatgtactgccactaccatcactagagtcacagagacaaataataaggtcaaggacagtagcatcaaaggaaaacccagccaaagagaaggagctagcctaatgtagagggctagaaaataagctaggattggtacaattccagctagagctggcaagaggacagacagtcctttagcaattataatctctgattctttaaaagcatagggcctataagatgccaagtccttactctcataaaagacattgtaaaatgcagtgaaagaagttgaaaaagcaagcactagaaaaatagcaaccatgaaactaaaatgaacaggactttcctcaaaaggaaaacgaaaggctatattactaaaaaagataagtaataaaagactggaaaaaatgtaagaacttaggactctagcggaaacatttactttttttccaggattcttagcttgcttctttcgtaggttagccagattagcttcttgagatgaatagaggatattgatatcaactaattttttaatgaccttgagacgcatctgaaacctcctcttttctaccagcaaggctaagatagatactttctaaagactggtctggattgtcttttctcaagtcctctacgctaccacaatagatcaaatgcccctttttcaaaatggcaatccgatcacagacttgctcagctacctctaggacatgagttgaaaacaagaccgtcttccctttttgtgcatgttccttcatcattttcttcaaatcaaaggcagcctgaggatctaaaccagtcaagggttcgtccaagacccaaatatcaggatcagacaatagtgctccgatgacaaagactttctgacgcattccgtgagaaagagtttcaataacctgatagcgattttcagcaaaatcaaaaacacttaatagcctagctagactagcctccaaatcagagctagtcagatcataggatgaagcaatcaattcccaaaattcattggccgttaagcgtaaaaataagtcaggcgagtctgctacataaccaatctttcgtttgatagccaagcgattttccgataactcctgaccgtctaccaaaatacgaccactacttggtgaaatgatactgactagagactttatggtggtcgattttccagccccattatggccaatcaagcccataatctccccattttcaatctgcaaattgagattgcttaaagcctctttatcaccatacaacttactaacattttgaaattcaatcatgagaaatctcctctctttatctatgtaatttactataattatagcgctttcattttaaaaatcaacattttatataaaatagtcaaaaacttattattcagttttacgcaaacgtttgagctaaccgatactttatgatagaataaagaacaagattgacaagtaagaggaaacatcatgcaaaatcaaacactcatgcaatactttgaatggtatctgccccacgacggccagcactggacgcgtctagctgaagatgctccacacctagctgatctcggcatcagtcatgtctggatgccaccagctttcaaggctaccaatgaaaaagatgtaggttatgggatctatgacttattcgacttaggagagtttaatcaaaaaggcactgtccgcaccaaatatggttttaaagaagactatcttcaagctattcaagccctaaaagcgcagggaattcaacctatggcagatgtggtgctcaatcacaaggctgctgctgatcacatggaagcctttcaggttattgaagtggatcctgtagaccgtacagttgaacttggtgaacccttcaccatcaatggctggactagctttaccttcgatggtcgccaagatacctacaatgacttccactggcactggtaccacttcacaggtacagactacgatgccaaacgccgcaagtctgggatttatctgattcaaggggacaacaagggttgggcaaatgaggaattagtcgataatgaaaacggtaactatgactacctcatgtatgccgacctagactttaaacatcctgaagtcatccaaaatatctatgactgggctgactggttcatggaaacgactggtgtagctggtttccgcttggatgccgttaaacacattgactctttcttcatgagcaattttatccgtgatatgaaggaaaaatacggtgaggatttctatgtttttggtgaattctggaatcctgacaaggaagccaatctagactatcttgaaaaaacggaagaacgattcgaccttgttgatgttcgtctccaccaaaatctctttgaatccagtcaagctggcgcaaactatgaccttcgtggtattttcacagatagcttggttgaactcaaaccttacaagactgtaacctttgtcgacaaccacgatacccaacgtggtcaggctcttgagtctactgttgaagaatggttcaaaccagcagcctatgccctcattctattacgccaagacggccttccatgtgtcttttacggagactactatgggatttcagggcagtatgctcaacaagatttcaaagaagtccttgaccgcctcctaaccatccgaaaagatttggcctatggagaacaaacagactactttgatgacgcaaactgtatcggttgggtacgttcaggtgctgaaaatcaatccccaatcgcagtccttatctcaaatgaccaagaaaacagcaagtcaatgtttgtcggccaagaatgggctaaccaaacctttgtagatttacttggcaaccaccaaggtcaagttacaattgatgaggaaggttatggacaattcccagtctcagctgcttcggtaagtgtctgggcagccaatacaatctaatagttcataataatcaagtcaggtccaaacggatttggcttttttgtagtcaaaaaagacctacccaccaaatggatagatctttatactcaatgaaaatcaaagagcaaactaggaagctagccgcaggctgctaaaaacacagttttaaggttgtagataagactgacgaagtcagttacctatacctacggcaaggtgaagctgacgttgtttgaagagattttcgaagagtattacttggttacaatttacctgctactgcatccaacaattcttggatcttagcttgattgcttcctcctgccatggccatgtctggtttaccaccaccacgtccatcgacgattggtgccaattctttgacaaggtttcctgcatgaaggtcttttgtcttgcttgctacaaggacattgactttgtcaccgatagcggcaactaggacaagaagatcagagtagtctttttgtttccagttatccgcaaaagtacgaagggcaccagcgtcagatacagatacttggctagcaatgtaacggtgaccattgacttccttcacatccttgaagatatcgcctgctgctgcagctgcggctttttctttcaattcagcattttctttttgcaattgacgaagttgttcttgaagtccttctaccttgtgaggtacttctttaagttgaggtgctttcaaggttgctgcgacagctttaagagcgtcttcttgttcacggtaggcttcaaaggcttccttaccagtcactgccaagatacggcgagttcctgatccgataccttcttctttgacaatcttgaagaggccaatttcagaagtgttgccaacgtgggtaccaccacaaagctcgatagagtagtcaccgatagtcacgacacgaacttccttgccgtatttctcaccaaagagggccatagcacccatttctttggcagtgtcaatatccgtttcaactgtcttcacttcaagagcttcccagattttttcgttgacttgctgctcaatcgcacgcaattcttcagcagtcacagcttggaaatgggtaaagtcaaagcgaaggaattcaacttcattaagagatcctgcctgagttgcatggcttccaaggatattgtgaagggcagcgtgaagcaagtgagtcgcagtgtggtttttcatgacacggtgacgacgattggtatcaattgccaaggtatattcttggttcaaggcaagcggtgcaaggacgtcaacagtgtgaagagcttgtccgtttggtgctttttgaacattggtcacagtagccacgaccttacctgactcatccaagatttgtccgtggtcagcgacctgtccacccatttcagcatagaatggcgtttccgcaaagataagagaggcagttccttctgatacagcttctacttctgcattgtcagccacgatagccaccaatttagaagataattggctagcattgtagttgaagacactttctacagtgatgttttgaagggtttcattttgcatacccattgaaccacctttaacagctgacgcacgcgcgcgttcttgctgttctttcatggctgcttcaaatccttcacggtctacagtcatcccagcttcttcagcgatttcttcagtcaattcaactgggaatccataagtgtcataaagtttgaatacatctgaaccagcaatgacagattgacctttttctttcaagtcagctacaatgccttgggcaaagtgttgacctgagtgaagggtacgagcaaatgactcttcctcgctcttaacaattttctcaataaagtcacgtttttcaagcacttctggatagtagctttccatgatttttccaacggttggaacgagtttgtaaaggaaaggctcgttgattcccaatttttgaccatgcatagaagcacgacggagaagacgacgaaggacataaccgcggccttcatttcctggaagagcaccatcaccgatggcaaatgaaagggaacggatgtggtcagcgatgaccttaaagctcatgttgtcgccatcttggtcataaaccttaccagacaatttctccacttcacgaatgattggcatgaagaggtctgtttcaaagttagtcttagcaccttggataacggccaccaaacgctccaaaccagcgcccgtatcaatgttcttgtgtggcaattccttgtactcgctacgaggaacagcagggtctgcgttaaattgtgacaaaacaatgttccagatttcgatataacggtcattttcgatatcttctgcaagaaggcgaataccgatattttctgggtcaaaagcttctccacggtcaaagaaaatttctgtatctggtccagaaggtcccgcaccgatttcccagaagttgtcctcgattggaatcaagtgacttggatccactcccacttcaatccagcggttgtatgaatctttatcatctggatagtaggtcatgtaaagtttttcagcaggaaaatcaaaccattcagggcttgtcaaaagctcataagcccaagtgatggcttcgtcacggaagtaatctccgatagagaagttccccaacatttcaaacatggtatggtgacgtgcagtcttccctacgttttcaatatcattggtacggatagccttttgggcattggtaatacgtggattttcagggataatggttccgtcaaagtatttcttaagggttgctaccccagagttgatccacaaaagtgttgggtcatttacaggaaccaagctcactgatggttctacagagtgacctttggtcgcccagaaatcaagccacatttggcgtacttgtgcactagatagttgtttcatattgtctccttatttacttgtttaatgtgattggctttccagcatttccacatagtcaatcgcgacacagagggaaatgactaggtctgcataagcatcctccagaaccgttacgctataggtagaggtcagatggaagagttccttcttaatttccgcaatcagctgatcgcgatcatccagcaatttgaaattcaaatcccagatattgccctcgatacgaagacctagattatcaaactcatacttatctcgccagaaggtcaacttcttgcgaatgacaaaactcgagccatcccaaagctgaatctcaaaacgaggtagcaaggtcaagatttctttactaatctgactaacctgttcaccagtcgcatcatagatggtaaaagttttgggaatcttaaaaaatgatccctccacctgataggcaatttctcctttgtcatccttgatagcgaagcgttcgcctccaagacgaaacttttgtttgacaagaaatgttttcatcaacacctccaaaaatcaaaagacaagctcatatcacgaagggcgaaaaaccgcggtaccaccttcattcaatgaacttgtcattctcttattcttatgcaattgtatgattgagtagcatgactttctagcttagatggctcgcagcaccgccatttctctggactaagataattgaaaatcaattctcaactttcttattataacgtttttttaagcttgcgtcaactggaaatcatcttaactaatagtagtgaggtaggagggaagaccttttaaaaatttaactactagtttcgaaatgtaagtagtaatatttaatttatttctaaaatctttctatctagcatagccctagaaggctatataaaaccctccagcgctgtttagtatgtcccccctacactgataagattccactcagagtagcttatcttgaacaattttggggattttgtgtcttcgtcatatactacgagatagtgcccttcatcattccaaaacttgcccaatacctcggagtctcttaaatccattttctggtttaagtagtcgctagtatactcaatttttggtgcatcttttaccccagcagtagaaaaactgctaccaataaagataaaagcataaaatagcaccacagcaatccccaagaatttaaagattttatagtttgtattattgttttccatgtttgtatattccttttctttctattttgtgtttccttaaatcccaagagggaattttacccccttatccaactaaatcattaagccaattttttcaatcacttcttggatctcatctagcgatactagaaaccactctttagggacaaagctatctccatttggtgctattaattccatatctaactgcttgtctgcaaaataatgatgaagagtagtttctaattttcgagcgctgaaattttgaacctcaaaactagctactaaacggacaggagcaaaaagataggttccttctctttctgaatttgctaaccgtttttcaatttgatcctgtgtaaaaccgattttatagagattactgatgttggcaatttgaggattgctactcaaagatttcactacatagatatatccagttgtaattcgttcgcttggactgataacagtcatcacatcttctatcaattctgttaccattcgtccatggcgcgttctatcgtgcagattagatacaaaagagcggagtaaggccttcttattttctgtaccattttcatatacgagatgaagttcagcattagtataaccattcttatcagtgaagtcttctcctttagaaacaacataaaccattactccattatccacatagaacataccaggtttaatttctttttcttttatcacatcagactttctgacttgacgacgaccttcactaatttcatcatgaacacgagtaaataatccctgataatcttcaaaatttcccatccgtttacgtgttcgtgttttatcacgcgcttgaatcgttcgtttataacgtgagacatcaaataaagatttttcagcaccatttactgactcaaacaatttatctgataaaatatctgttaaactagcaggacttgaaataggggtctcggactcaactatatctatttttagtagcccaaattcatcataaggttctaactttcggatgctattaggagattttctaataccattcaatcgagaaaataaactgcgttctttaatatttctagacttttgtggctcttgcccattattttctctcacccaatctataatttctaaaaatttctctacttcatgatctgtaactatttttttcttaggttttaaaggagttattaaatgttcaaaatcagaatcattaaaaatgtcatttaagtttttgaaatcagtcattaccgctctccatcttcagcttcatctgagataattgtaacaaagcataagcaagtctctgttcgtacttatcgtgacttgatttatctggatgacgaccattttctttcaaaaattgcttaatttgaggataaagaattaacagttcttcttcagaaaactccatcttctgaccatccatataatcttgtatcagacgtaaagtcggagcatcaatttcacgtgatataacttcgtaagctctctggaagggattaatctgatcaatcaaatcaatagataactcatcaatattcacaaatttatctgccatttttagaaaatctgtttgccctactccctctttccgttcagctgattgaaccaccgattgactaataaactgttgacgaacttcttcaacttcagccccacttaagtcagggtagatttgtttaatgatggctggaatcatctgcttattaatgacttctgcatccgttcctgcagcaattgcagtttggatacgcggttcttgcaatatactagcacgtaagtcattcaaatcattttctatgatatcctttgttctctgtgtactaggctcttttaagcctttaacaaacatttcggcaccagaagatttctggtcttctcggtcttttcgtttgaacttgaaatttggcgctaaaacagactccatcaatagactagctgtaatggccttcataacattattcacagcgaagaaaacttcatcatcttgagcatctggttgagaaatgagattggtaaattgagcgtgtgacttattggaactatcgcgtgttactcgacctataatctgaacaatttctgttagcgactgacgatagccaatcgtcaaagcatactcagcataaggccagtcaaaaccttctttagccataccaagtgcaataatgatatcgagatcatttaaactgctcatcttgtttaggtaatcctgtactttttcacgttcttcttctgtgacaaggtctgcaactttcaatacacgacctgtttcctcagtaactaaccataatccagtcttaggatctggaactgcttgccccagttcgtctaaaattcggtcaacttcatcatacttatccttggttgactcacctgagtttacattgggaatatgaataatggttttcttgctcgtgtccagtacttcgtgcaaagcatccgtataacgaccacgataaaagttatagcccatggcaaaacttttcagatatttgtacccctccaactgttcataataagtataggataccttgtcgaatttttgctcatcttcaggtgccaaaataggtacagaatctccacggaaataagagcccgtcatagctactacatgggctgttgaattggctaatatgtttcttaaggcatttcctaaaactgaattatcatcttgagatacatgatgaaattcatcgatagctaaaagaacatcattaaaatcactatcagccagctgttcaaaagcaaaacgcaaggtggcatgcgtacagattaaaactctatcatcaggagactctgaatgcataaagtctacaaactgttttaccttacttttactggtcccttgttcagtcaaattatttttggaaagaacttcccaatcccagtaaaaaccataatctgtcaattttgttgaacgaaacgattttccgatagatctttctggaacagctataatagcttttttcagaccttgagcatgtaatttatcaagagcaataaacatcaaagctctcgacttaccagatgcaggaggcgccttaatcaataagtgttgagaagttctcttagcatatacccgctcctgcatttcacgcataccaagtgcattattagattgactagcacctgtaccattgtaattaatttcaaatatatttgaggtcatttcgcttccttttctgtcatttctttatacagattcaataagacactgagcctttcttcatctgattcaaaaggcttttgctggtaggcacgttctacgataccatcaattttttcatgtgcttgacgaagacgttcgttcatcggtttattggctccaccgtacaattcagccaaggttccaccttcttcttctcgaacatccagcatttcaaaaacagcttcttcaagcatatttttccgactatctgaaagttctggaattgggaatgtattataaaccagtccagctgaataacgcaaacgtgtctctaattttcctccaatagattctaaccaaaccatatgcattttggattctaagataccaagaagccaaataggagcattgtaaataaccatagcagaatctgatacaattgtgtcatcttcaataaatcccataggtacataagtacgagattctgatgatacacgtggaacaataatggcttgacaaccttctatatctcctttttcatatgcttcgtcgtattcacctcgttgtacaaatttccatggcgtagacgcagtttctcttgttccagcagccttagaattcaggcgttcttgccttacattttcaaataattgatggaattcctggatcttatctaatttagtatattcatcttgatcaatccaaatagtatatctaaaatttccattgatatactcatctgctccaatatactttttaaaatacacttcagtttcaggatatctttgaactaatttatttttatcatcatttgtcaatattagatatttacttcttggcatattcccaaagactatttttggaaaattatttaacttctctgaatcattgtgattagatacaataatatcatctgcgaaagctagatagggatttatattctttccataactttctcccttatcactatatataatttttttcttatcatttttatttgaaaatccaataatcgtaactgtaacccctgcattatgggccgcgctattgttccatttaaaagattgatatgcaaaggaaatttggccatatcgtagaagaacactccacaaaattgaaacttgctcaccttgatttattgaatttgttgttacaaaagcatattgagcatttttaccataaataaggtgagttgccttataaaaccatcccgaaatataatctaattttttagaagaaatttctgaacaaatcacattttctagttccttcttttgttccaaggtcatttttttagagcctatatacggcggattcccaaatatataaacttcgtcatctgccttagcatttaacacaatttcccagtcaattcttagggcattcccacaaacgatatttccagcttctcttaagggtaatagtcttggatggacatcagcaagcgcttcttccatctccacattcatctggtgttccgctatatacaaggatagccttgctacttcatgagcgaaatcatccaattcaattcctgaaaactgggatagagaaatcttagacgcatcagcaatcaattctccttgataaacagctttttcattcaaggcttcacgaatttcacgctgtttgactaagatattgatttctaaacgacgaagttctttataggtaatgatgaggaaatttccagaaccacaggcagggtctaaaaacttgatagaggccatacgagtaagtaaatcttctaacttaggtaagatttgtcgcaattccttgcgacgatgttcatcgctaaagtcaccacctcctatataataatcagctcgttcttctaattccgtaaatgctactcgtaaattatctaaaaatagtggtttgatgaccttcataatattgggcacgctagtatagtgcatacccgatgttgatcttgcttctgcatttgccacagtttggatcattgatcccaaaatatctggattgatttcattccagttgagcaattcccctgcttcaatgagtagttgacgagttcttttattaaaaataaggtcatgatgtggctctgaaaaaagcttaccatttacataaggaaaatctgataaccacgactccaaatcctgacgactaaattcaggcatatctaaaacagtaaatagttttctaacacactcattcaagtcagaaccatcttcggatgtcctcatcttaataacatttgtgaaagctcccttggagatgatatttgtatcttctgcaaatagtagaaaaagaacacgaatcaaaaataaattaaatgatttaccatcagtttcagtgattgctagttcaggattgatagaaattagttcatcataaagtttggtgaaacgctctgccgcttttacatcagcagggttttccttatcataatcaatcttttcaattccattccaaggtaaaaagaaatcacaatgggctggtaaatcattaaaagaaattgctagagttagacctgtctgtgtatcctttgcatataattcttgaaaatctgttgtaataataaatcgagattttcgaacctgcccctccaactctttatcaatctcagtcagagcaagtaatggctgattttcaactttacgaaagtataatttattttttattataaaatcatcagatgccactttacttgctcttgttatggtcgttttagtaatgtcaaataatgaaataaaatcaataataaatgtcgattcattaagattctctactaaaaccttggttctatcctcaatctcagtgatatttaataactttttagccattagatacctccaagaaacgcaaaaagcctactggattttcagtaggtttcaatctatatttttcacatatttttattaggttatatatatatatatatatatatatatatatgcatttgcgtagtctgactcattttgaactcctttagaattaaattttcagagatgctataaacaattctaataactctcagcctaaaactattataccatgatttctattttttcaaaaaaacgaaccagattaactgattcgtttcgtgactgctaatctcctacttccgatacattttaaactgtaggaagaggtcgctgtattttcccgtccatttatggtcaaatttctcataaacttctaggtgtttcatggtttcagcatctggatagaaggccttgtcttcttttttctcctctgggagtagttccttagctggtaggtttggtgttgaatagccgacatactccgcatttttaagagcattttcgggtttcaacataaagttgataaaggcataggctgcgtcttggtttttgactgttttgggaatgaccatattgtcaaaccaaaggttgctggcctcagtcggtactacatagcgtagattttcatttttttctagcatttggctggcttcacctgagaaggtcacaccgatagcagcgttgttctgaatcatatagcccttcatctcatccgccacaatagccttgatatttggagtcaatttatagagcttatccactgtttcttccaactgctgggtatccttggagttgaggctgtagccgagggagttgagccccagtcccaatacctcacgcgccccatcaaagagcatgatagagttcttatactctggtttccagaggtcgtcccaatgctcaggagcctcatctaccatggtttcattgtagacaattcctaaggttccccagaagtaagggatagagaatttattgcctgggtcaaaggactggttgagaaactctggtccgatattttcaagaccttcaagttttgaataatcaagcggtaccaagaggtcttcgtccttcatcttgttaatcatgtattcactaggaatggcaatatcgtaggtcgttccaccctgcttgatcttggtatacatggcttcattggagtcaaaagtctcgtactggacttggattcctgtttcttctgtgaactgagtcaagagttcaggatctatatagtccccccagttgtagataaccagtttttgactatctcggctattgattttactatctaaatgcgtcgcaattccccataagacgaggataatggctacaattcctgctaaaaatgaatagagttttttcatgcttgctcctccttctcacgtgagataaagtaataaccaacaactaggataatactaaagagaaagacaagggcagacagggcattgatttctagcgaaatccccttgcgagcacgagagtaaatctcgactgacagggttgaaaagccatttcccgtcacaaagaatgtcacggcaaagtcatctagcgaataggtgaaggccatgaaataacctgcaattatagacggtgtcaggtaaggaagcatgatttccttgaacatctgaaattgactggcaccaaggtcataggccgcatgaatcatgtcaccgttcatttccttgagacgaggcaggaccatcaagaccacgataggaatcgagaaggccacgtgactagatagaacggtcaaaaagccaagtgaaaacttgagttgagtaaaaagaatcaagaagctggcaccaatcataacatcaggcgcaaccatgaggatattattgagtgaaagaaaggcttcttggtatttcttacgagactggtagatataaatagctccaaaagtcccgataatggtcgctatcaaggctgacaggaaggccaagaaaaaggtctgagtcacaatcaacataaggcgaccatcgccaaacatagttttaaaatggctcaagctaaagcctgtaaagctattcatgtcattgcctgcgttaaaggcatagccaatcagataaaagattggcaggtagaggacaagaaagaccagtcccagataaaggttggcaaattttttcatcgttctctcctttccttggtcacccacatagtgatgaacatggtcaagatgagaattacaccgatggttgaacccataccgtagttgtcattggttaggaaattctgttcaatagccgttcccagcgtaataacacggttcccaccaatcaaacgggtcagcatgaagaggctcaagctggggataaagacagactgaactccacttcgcacaccattcatcgataaagggaagatgacatggcggaaggtttcccacttggtcgcacctaggtcatagctggcattgatgagattgttgtccatatcgtccaagacattgaaaatgggcaaaatcataaaggggagctcgatgtagcttgcgacaaaaataaaggagaaatcagtaaagagcaactgttgcgaaccgattccgataaattccaaaaattggttaatagagccattttgaccaaaaattccgataaaggcataggctttaaggagcaaattgatccaggtaggcaggataatcagcataagccatagttgacggtgtttgagacgggtcaaaaagagggctgtcggataactgataagcagggtcacaaaggtcacaatccctgcataaagcactgagttgaaactcattttaagataggtcaagttttgtgacgcaaagtaagatttataattttctaaactaaactgaccttcaatgttgaaaaaggattgtccgaaaatcaagaccaagggtgcgaggacaaagagtacaatccaaagcatgtagggcactacaaagagtttagagcttgttttcttcatctctttcctcctcgattgcattgatcagacctgcttcttgctcttcgatttctacgtactcctcaatacgagcatcgaactcttcttcggtttcattgagacgcatgatgtggatgtcttctggttcaaagtccagaccgatttcctcaccaacaatggccttacgagtcgagtggatcatccattcatttccaagttcgtcataggcgataatttcatagtgaaccccacggaaaagctgggtatcgaccttaacttggagcttgccttcttcaggaagggtaatccgcaagtcttctggacgaataacaacctcaacaggttcatttggcttcatcccaccatcgaccgcttcaaagcgtttgccgttaaactcaaccaagtagtcctcaatcatggttcctggcaagatatttgactcaccgataaaggtggcaacaaagtggttaattggctcgtcgtagatgtccacaggtgttcctgactggacaatctcaccatcgttcataacaaaaatccagtcactcatagccaaagcttcttcctgatcgtgagtaacaaaaacaaaggtgattcccaatcgttgttgcagttcacgcagttcgtactgcatgtctgttcgtaattttaagtccaacgctgacaaaggctcgtccaacaaaaccacacgaggttggttgatgatggcacgtgcaatagccacacgctgacgttgtcctccagagagtttacggatggaacgtttttcgtaaccttctaactgaaccatcttgagaacttccgctacgcgtttctcgatttctttcttgtcaattttacgcaagcggagtggaaaggcaacattttcaaacacattcatatgtggaaacaaggcataggattggaagaccgtatggacgtctcgcttgttggttgggatgtcgttgatacgaacaccgtccagcaaaatatctccagtcgtagcatccagtaaacctgcaatgatgttaaggatagttgatttccctgaaccagacgcgcctagaagagtatagaacttcccttcttccaactcaaagttgatatctttgagaaccttggtgttgctgtcttcaaaaactttagagacgtttttgaattcaataattggttttttcaattgtcatttattccttctttttcatagattaacagatcagggctctgtcaggccgctactacctcgcgtaggagattgaactgcctacattcttctgcactgacgataggctttcaccccctttccatgacatagcagcagcttttcaactacagcttcctacttgctttcacccaagatacgaacttctctctcaagagtaacgccagagtgttccttgactttttcgataacagactcaatcaagtcctcgtagtctttagccgttccatcagcgacattgatcataaaacctgcgtgtttttctgagacttctactccaccaatacgatagcctttcaagccagcttcagaaattaactgacctgcaaaatgccctactggacgcttaaagaccgaaccacaagatggatattctaaaggttgcttgagttcacgtagatgcgtcaagcgatccatttcttgcttgataaccggatggcttcctggggctagggcaaatttagctgataagacaactgcaccagactcctgaatggctgaatggcggtaaccaaaagccaagtccttgacagatagggtctcgatttctccatccttggtcaaaattttacaagactgtaagatgtgggcaatctcgccaccataggcacccgcattcataaagacagcaccaccgacacttccaggaataccacaagcaaactcaaaaccagtcaaactatgacggagggcaatgcgagttgtttcaatcaagttagcaccagcctcagcttcgatggtatagccatcaacggaaacatgattgagcttgtcacacaagataacaaatccacgaatcccaccatcacgaacaatgatgttgctagcatttcccagcaccatccaagggatattttcttgattggcaaatttgacaacgcgcgccaactcaaaacgatttcgtggaaagaccaaataatcggcctctccacctacttttgtataactatagctatgcaagggttctttgaaacggatatcaatcccttctaagatttcaagcatgttttcttttactgacatgacactcttccttttacaaaattcattccattataccatttttaagaccatttgacgaccctaaaaaaatcttgggcttattttaaacaaaaaaagaggtttccccctttttcttatgattttttgcaaaagatagccttggttccataggcaactaggatcagttcaactagtagaatgacttcaactaagactggacttgtaagccagccaacttgggctagagatggtgccaggtcaaagaaggcatgtaggccataggctgctaggagataaatccatttcttctggcgaacagcttggtaaacccaaacagtcaaaagcaattggaaacctagagccaaaattcgctcaaaaccaagcaaataaatctgccagacagaaagtgactgaatggtttttaacatattttcagacagcaattgcatgacctgtggattctgagtttgaactgctgagagaacgatgtagagattaatcaaactagtaagacctaggaaaatcaactccaagccaccatgccccaatccataagccaaggcatctgccttttccaaacttctctttttctccaaccatttgaagaaaataagacgagccgtttcctcaaaaaatgctgccatggctaggccatagatgatatagacaagcggatggtcttgtaagagggcaatactaccgtctttttgaggatgtaaaaccaagatatgcaccagtttttccaaaatctgtgaagagacaaagaaggcaacagcccccaagcccaagacagctagattaatctggtgtttctttttggcataccaaatgcttcctatcaagaaagccagcaacagcaacatggtaataatgatatgaatggtcattttcttctcctattccgccttttcaatatcttttttcatctcgtcaacattgaacttagcaaacaagtattgacgatcttggactggaaaacgttggtccaactggtcaaccgctcccacctcgataatcccttccttgatgacaaagtccatgacatgcccaccgaaggtcaaatcatctgagatgaagtgtagatgatagcctgccacactgactccatggaaaatctctggcgtccagaaaccaacgatggttcccaccacattgtcacgacgatattcaggttgatgggttgcgacatcagcaaacttggtctctggtgtcgacttgggaatcatacgcacatgcatatgtgaaaattccccacgaatcttgatagagcggaaaagattttccccgtcataataagactcgattcgctcttccaattccttgtctgtcatctcaaaccgctggcggaaaatgacctctgcttgatgcggtactactgctgcataaggaatgagagcatctggtgatacttctacaatttctggttgctctcctgatcctttggcctgataagccttgccatccaagacaatcaattccccatcaatggaatccaaggttcccaaaccaaggtcaccatgctctagcaattctcctactgtcatggtaccaccataaaggccagccatcaaggctccaagggtattgtattgaaataatttcactggttcctgcacgttcttatccattcactttcttgtctgttatactcaatgaaaatcaaaaagcaaactaggaagcgagccgcaggttgctcaaagcactgctttgaagttgtagatagaactacatatatacggcaaggcgaagctgacgtggtttgaagagattttcgaagagtattattctataaatgttactcctaagtataccacatttgcccctagatgtgaacgagagaaacaccctagacattgccaagaaagaaaaaaaagggtacaatgtaacaaaatcaagggaggtctggaatgaagaaacaaagcaagtaccaagaggtcgtagcttatctaaaaaatagtatcgagtctggacgctttccaacgggtagccgactgccttctatccgtcaactgagccttgactttcattgtagcaaggacaccattcagagagcccttctggaattacggcacgaacaatacctctatgccaagccccagagtggctactatgtcctagaacaagggcaacaccaggatctagaaatcgaagtcactgacgaacatgccagtgcctatgacgatttccgactctgtgtcaatgaaaccttgattggccgggaaaactacctcttcaactactatgacaaccaagaaggattagaagacttaagacaatccattcataaactcctctttgaccaagccctctactgcaaggctgaccaactggtactgacttctggaacccaacaagccctttttatcctttctcaaatttcctttcctagtcaagccaaggaaatcttggtggaacagccgacctaccatcggatgaatcgcctcttgattgctcagggattggactatcaaacgattgaacgaggcattgatgggattgacttggaggagctggaaggtcacttcaaaacaggaaaaattaagtttttctataccattcctcgatttcactatcctctgggacattcctattcagagcaggacaaacgagctattcttgacttagctgccaagtatggtgtctatatcgtagaggacgactatctgggggatttggactccaagaagggccagaccttccactatcaggatacagagaagcgcgtcatttacataaagtccttctcaaccagcctctttccagccctgcggataacagcactcatccttccaaatgctatcaaggaagcctttgtggcctacaaaaatatcctagactacgacagcaacctcatcatgcaaaaggccctgtcactctatattgacagtcaattatttgagaaaaatcggctagctcgcttatccaatcaggaagactaccaaaaacaaatcgaggaaagactagataacactccttgtccccttcctcactttcccctacacgatggtttattacttgatctcagacagtatcctaaaatcgccagtctcaaacacagtcaactgggcttagacttctttgaagaggcctatttaagcacctgtccttatcaatttgccaaggtgtccttagacaatctggaaaatgttttagactatttaaaagcagaattggattgacttccaactctgcttttttcttatactcttcgaaaatcaaattcaaaccacgtcagcgtcgccttaccgtactcaagtacagcttgcggctagcttcctagtttgctctttgattttcattgagtattattcttcaacttctgttaaggttgccgctttttcaagatatttttggtaggtaccgtcatccttgagtttttggatgaccttgtccaccacttcttttaaatcagcactattttttctaagggcaactgcattagcttcgccgtccttcatcttcaagctgacagttgcgacagctaagtcggcgtttttagcagcatagctaagggcaacaggctcatccatgtgaacagcatctacttttccagcctgcaattcattgacagcttcacccatattggttagggaagtcaattgagcttttggcaattgttccttgaccatagcttctggaacagtccctttttgggctgcaatattagcactttcaaggctagttaaatccttgtatttttctacatcagacttacgaaccaagaaactaatcttgttttcatagtaagggattgaaaaatcaaagacttcttttctctcatcagtagcactaattcctgcaactgctaggtcagccttcccagtttgaagactggtcaaaacattgtcaaaactcatgcttgagatttccaatttcaccccaagttcatcagcgatagcttgggccatatcaatatccgcaccgactacctgatttttcccgtcaactaaggattggaattcaaaaggtgcatagtcaggactagtcgccacaactaatttccccttttgcttaatggcctcaacagctgactgagaaccattagaacccgactggcaagccactaagaagaaacttgcaagaaagctacataaaacaaatatccattttttcgatttcataaataaacgacctctctgttaattttgtataattataactctatccaagttgcttgtcaagtgtttttttgaatttttatcttaaaaatatttttttcattcaaaaaaggagctatctattgatttcaagctcctttttatacagaatgactctattttatagttcgacaatcttacctgtttcaaagtaaacaacccattcacagatattcttggcatagtctccaatacgttccaagaaggcaatcacttggaaataatcacgacctgtaacaatggcatcaggatttttcttgatttcttctgtagccaagtcacgaatgctatcaaagtaatggttgattttttcatccattgctgctacttcataggcctgatctactgaaccattgagatagagttcaagggctgcttcgacgaagttcttgacatcgcgacccattctctttatttcttcttcaacagctgggatgcgttgctcccccttcatacgaattgccgccttggcaatggaaacggcatggtcacccatacgttccaagtcagatacagccttcaagactgtcaaaacagtacgcaagtcctgagaaacgggttgttgaagggcaatcatttcaaatgatttcttttccaatttcacttcgtattcgttcacttctgcatcgtcttcgatgacttccttggccaaatcacggtcatgcgtaacaaaggcacgcactgtccgattgatttgggatagcacttcttgtcccattgcatagaactggttgtgcaatttctccaaatcttcttcaaattgagaacgtaacatcatttatctccttatccaaattttcctgaaatataatcttctgtttccttgtgttgtgggttgaggaacatcttcttagtatcgttaaactcaatcaaatctccatctaggaaaaatcctgtcttgtcagagatacgagaggcttgttgcatggaacgcgtaaccaagagcatggtgtatttatcttttagagcatacaaggtttcctcaatcttaccagccgagatagggtccagagctgaagtcggttcatccaagagaatgattttaggactagttgccaagacacgggcaacgcagacacgttgctgttgtccgcctgaaagcccgatagctgaatcatgcaggcgatccttgacctcatcccagatagaagctcgttgcaaggctttttcaaccgcctcatctagaacctgcttgtccttcactccattgatacgaagcccgtaaacaacattttcgtagatagacatagggaaggggtttggttgttggaaaaccataccgatttccttccgcaattcaactgtatctgtacgcgggctgtaaatgttgtggccgttataaaccactgaaccagttgtggttacctctggattaagatcccccatgcggttgatagcctttaggagggttgatttccctgatccagatggaccgatcaaggctgtaatttccttgggttggaaagatagggaaacactattcaaggcctttttttgattgtagtaaacggacaggtctgacacctgtaaaatcgcttctgtcatactgtttcctttctatccaaagtgtcctgttacgtagtcattggttgactgtagtttggcattttggaaaatattagaggtcttatcgtactcgatcaagtcacccaagtagaaaaatcctgtgtaatcactagcacgcgcagcctgctgcatgctgtgggtcacgatgattatggtgaaatctttcttcaattccaacatggtttcttccagctgagctgtcgcaatcggatccaaggctgacgctggctcatccatcaagagaatatctggtttaacagagatagcacgagcgatacagagacgttgttgctgaccaccagatagggtcaaggctgacttgtgcaaatcgtctttgacctggtcccaaagggcagcctgacggagagaggtttccacaatttcatccaagacttgcttgtccttaactcctgcacgttcatgggcaaaagtgatgttacggtagatagacttggcaaagggatttggtcgttggaagaccattccaatatgcttacgcatctcataaacattgatttctgggcggttgacatcaattccttgatagaggatttgacctgtgaccttagcaatatcaatggtatcattcatacggttgagactgcggaggtaggttgatttccctgaaccagaagggccaattaaggccgtaattttatttttttcaaattgcatatcgatgcccttgatggattcttttttaccgtagtaaacatgtaaatccttagtagagagggccactttctcttcaggaaaggtgatgatatacttttcatcccaattatattttgacatggcttctcctttaggcagcggttaatttcttatgtagatagcttccgagtttgcgggctccaaagttaaagatgaggataaagatgaggagcacggccgcagaacctgctgatacgatagttccatcaggaatggtaccttcactgttgactttccaaatgtggacagccaaggtttctgcttgacggaagattgagattgggctagtcacactgagaatgttccagtttgaccagtccagggctggagcggattgtcctgctgtataaatcaaagcagcagcctcaccaaagatacgaccagaagctaagacgaccccagtcacaatacctggaagagcttctggaatgaccacatggaccactgtctcccaacgagaaatcccaagggccaaaccagcctcacgttgcgtatggtgaacgtgtttcaagctgtcctcaacatttcgagtcatctgaggcaagttaaagactgtcaaggccaaggcacctgaaataattgaaaatccatactcaaactgaactacaaagatcaagtaaccaaagagacccacaaccactgatggcagtgaagacaagatttcaatacaggttctgacaaaattggtcacaggaccttttttagcatattcagctaggaaaatcccagcccccatagacaagggaacagagataatcaaggtaataaccaaaaggaagaaggaattatagagctgaattccaatccctccgcctgcttggtaagaagatgatttgccagtcaagaaagaccaagagatgtggggcaaaccacgaaccaagatataaagaatcaaggatgccaagatggcaacgataattcctgcaattgagtagaggacagctgttgcaattttatctaatttcttagcgtgcatagtttttctttcctctttctttcgtaatcaatttaatcacactgttgaaggccaaactcatcaaaagcaagactaaggccagtgaccagagaacgttattgtcaacggttcccataacagtatttccgatacccatggtcaaaacagaggtcaaggtcgcagcaggtgttgttagtgaagttgggactacggctgagtttccgaccaccatctgaatggctagagcttcaccaaaggcacgcgccatcccaaagaccactgctgtaaaaatccctgaacgcgctgccttcaaggtcacgcgccagatggtttgccagcgagtggcccccatagccaaactagcttcacgataatgacgaggcaccgcacgcaagctatcggttgtcataaaggttaccgtcggtaaaatcatgacaaagagaacaaaaatccctgacagaatcccaaaaccagttccaccaaagatactacggacaaaaggaactacgacctgcaaaccaataaatccatacacaactgaaggaatcccgaccagcaattcaatggctggttgcaagattctagcaccttttggtgagacctccgtcataaagactgccgcaccaatggcaaaaggagttgcgataagtgctgataggattgtgacaataaaggaacccaaaatcataggaagggcaccaaattgtttacctgaaggattccaagtttggccaaagaggaaatcaaagatattaaccccatttacaaagaaggtagacaaacctttttgggctacgaaaatcaaaatcatagccacgatgataacaatcaaagacagacaggcaaaggtcaagccttttcctaatttctctagacgagagttctttgagggagaaagtaattttttagctaattcttcttgattcattagtgactcccttctagtgctgtcaccgttcctacagcatctttttcaaccttcatttccttgacagaaatatagcccattcccttaacgattccactttgcgcttcatcagagaggacaaagttgaggaattctgccaccaattcatttggttgacctagggtgtacatgtgttcataagaccacaaaggccagttattgcttgtaacattttctgcaatcggctcatagccgttcaacttcatgcgtttcaccgagtcatccacataggcaaaggctaggtaagaaatggctcctggtgtctgggaaacaatgtttttgaccatcccatttgaatcctgttcttgactctgcacggccgattgaccatccatgataacactatcaaaggttgcacgtgaacctgaacttgccgcacggttgataatggaaatggctaggtctttcccaccgacttctttccagttggtcacttgacctgtgaagatgctacggagttgttcagttgtcagattttcaacatcaacttccttgttcacaatcactgccaagcccgctacagcaaccttgtgatctactagagctgatgcgttgataccgtctttttcctcggcaaatacgtctgaatttcctacatcaacggctccagactgaacctgagacagacctgtaccagatcctccaccttggacgttgactgttttcccaacgtgcagagagccaaattcatctgctgctgcttcgaccaaaggctgaagagccgttgaaccaacagctgtcatggattccccacgatcaatccagctagcacatcccgccaaagaacctgctagcaaaagagccgcaagggatagagcgagttttttcctttttttcactgtttttctccttgaaaataatggtgaatgctgtgaattttttcaactatttatttatgtttttcttttgaaaattgggagccaactgaagttctttgcttagttttactagtcatttgctcagttaccttgcccaccaattttgacttaaaatgaaagacaatttgaaaaaaatccatacttccactataacatagacaagctactttgactagcattttctcttgaatctgaggcctttaggaaaataatttttcaaaacatttccagtcaccttagcaaagcccaagccattacctttaaccaaaacttggtaccaaccatttggcagactttctgccagctgaacggtttctccagcgacatactttacaaacgcttcttgatcaatttcaacagactgcttgacctgactcggtttcaaggctagaccaagagcaaaactaggctcaaagcgtttcttcttaaaagtgcctagatgcaggccattccgagcaatcttgagtttccctaaatctggcaaaagttctggcaggagatagagttggtcaccaaaagtctgcaagatacccggtagattaactatcaagtggttttgggcaaattcctgccacaagacaacttgttctcggctgagattgctcttacttgccttaaatttaggagctggattgtcacccttaaactgtagatgagctacaaactgcccctctcccttaaaatgatgtgggtacatacgagccgtttctggcaggtcaataccagctaccattccattgatatgatcaactggtaacaagtcaaaatcatactcttccagcaaccaattgacgatctcttcgttttcctcgggtgcccaggtacaggtcgaataaaccagacgaccaccttcagctagcatggttaccgcatccgctagaatttctctttgcaagctagcacattgactaggataatcaagactccaatagtccatagcatctggttgcttacggaacatcccttcaccagagcaaggggcatcaaggacaatgaggtcaaaatagcccttaaaaaccttggccaaacggtcagcagattcattggtcaccacaacatttgtcgctccaaagcgctccatgttttctactaaaatcttagcccgtttgcttgaaatttcattggaaacaaggagaccctcccctgctagataggctgctaattgagttgatttaccacccggtgcagctgccaaatccaagaccttcataccagggctgggctgggctacctgagcaaccatctgagcagcgggttcttgcgaataaaccaaccctgtagcatgctcaggcgatttccctgaaaccttcccatagtggccccaaggagtttgaggaatggcatcaggaaaggaaactgtcgcttcttttaaaggattgatccgaaaagccgaaaccgcttcctcctcaaaagaggcaagaaaatctcttgcctcatctcctaatatctcttcatatttttcaacaaatccttctggaaattgcatctaagttcttttcctttcgtaaatataggactgaatttcctcctgcatctcaagaggtaacatcatgaccggttgtctggtttgaaaatcaagcggttgaccagatagggtcacaacccgatagcccagactttcccctaaaatacttgcagcggcataatcccatggttgcagataggtgacataggtcaacaaacgccctgacaaaatcttggcaaaactaatggccgcactcccatagacacgtacaccgaggaccgctcgacccaaatcagccagaccccattcattggtttccagcataccactattccctgcaataaggaaatctccaagtggttttgctttaaagggagctaggggcctatcatttagacaaactggaaattccccaccaccgtggtaacaatcccctttgaccacatcataaatcagaccaaactgtccctgaccattttcaaaataagccatcatgacagcaaaatcttcctgctgggccacaaaattattggtcccatcgatgggatcaatgacccaaaccttaccctctttaaccgaggctcgcagacacccttcttcagcacaaatcttatcctcaggataacgagacaaaatctcactaaccaagagttcctgaacttccttgtccagtctggtcaccaaatctgttggagaggacttggtttcaacacacaagtcttcctgcatatggtcaagaatgtactgacccgccttattgacaagctctttagcaaattcaaatttactttccaagagaaatcttcccttcccctttttccttggcagtctgaactgctcgataaagcgaatagccactaactgtttcaaattctcgtcccaaacgtttttcttcgctcttgcttggcacgaccgctttgaatcccttataggagtccagtaactttttagcctctaccttgccttcataggcagcttcaacatcattaaaaaaagaaagcactgaagcaagttcttcagtgctccacgacaaatctagtgggtaactatactgtttgttcattaactaataccagctctcattcttgcttcttttagttcttgcttacggtaactacgagggagaaaagcacgaatctcatcttcattaaaaccgatctgcatacgtttggcatcgataataattggacgacgcaaaagacttggatactgctcaatcaaatgaagcaattctgataccgaaatactttctacatcaatatctaatttttgaaaaatttttgaacgagttgaaatgatgtcatcagtaccattttcggtcaaggaaaggatgtgttgcaattcttttcttgttaaaggactggtcataatattgtgttcctcaaagggaaccttatgtttttctaaccaggcctttgccttacgacatgaagtacagctcggtgatagaaatagtgtaatcatgcttttctcttcttatctatactttgctacttctattatacaaaaaaataaagcgcttgactagagatttttagaaaaaaaagcctattttttcaagaaaaatagactgtttgcgaacgattaactctttttagatttgattaattcattcttgacaatagtttcgaatcacatacctaattgatttatgcaaaataagaatatctttcgtttcacttcctacggcttttcaggtatagaaaaccaaagaagctttcatagagggcaaaaaagaggaggaaggcatgaaggaagaaagtctctggtaaaatcagaatcactggatccttggctggatcaaaaagccaagtatcatctcccacaaagagaatttgatggaaaagggtaaagaattggtcaaaaccaatcaacactcctccaaggccaatcagcaaaggcaaaaccactagagtcagaagccctttactaaatagagataaaaagccctttttcacaatcctattgacaaagacgtaaaaacttggcagtgtcactaaagctactagctgaaccaggtgaaagaggttcttgaccactgcaaaatggtgtagcccagcagctgacgaacgaaaatctggcatctctaggacctgactaaatggattggtcagataattcatcaagatatgaaagttgtactgaatggtttctggttttaaatagacccgatccgttaaacttaaccactgaatttccagcggataaaaaatccaagccagatagatagtcagaaggattgagagggagagaagaaagagcatagagctccaaaaggtcagtttagttttcatcaaaatcccactccgcaaggctagaaaccacatgagtcggtgcaattggtaggtctgccacttcttctgccttggtaaaacctgttgtcaccaagagcgttggaatgccgttgtcaatcccagcccgaatatctgtcagatagttgtccccaaccataatcaactcttcacgttccaagcctaagtgctcaaccgccttgtccataatgatagcatttggtttcccgatataaacaggcttcactcgtgttgccacttcaagcagcgtaatcagtgaaccagcacctggcaaaagaccgcgttctgttggaatgttaaggtcagggttggttccgataaagtgagcacccttttggatagctagagttgctgtcgcaaatttttcatagtcaacttgccagtccaggcctactaccacataaggcaggattatccttgtcttccacataaccagccgccttgatggcttccttgagtcctgcttctccgatgacatagactgtcttttcaagtccccaagtcgttcatatagtcgatagtcgccaaagtcgctgtgtagacagtcgatagaggagtatcaatattaaaattctgagccaacatctcctgaacactctctggagtgcgggttgtattgttagtcacaaagagataggggatgtctcgcttttgcaattcgtggacaaaagcctctcctgctggaattcgatctttccccttataaatggttccgtctaaatcaattaaatagcctttatacttcatatttttctctaatccttcttcatttcttgccaagtgatgatagcttgggcattggtagccccgtcgcttgtaatctcatgcttgctttccagtccagtccgttcaacagccgatgtaatcaccccacctggtctaacttccttgacatacttgaggttgattttcttgggaatatattgggtcaaaaaatccgctcccataacctcaaaaatccagtccagatacttactgttattaacatgaccattcatatccaagtcgtaaaaacgaacatggtaatccttgctgaatggttcttccaaagactcatactttggcccacggataagctttttatcaaaatcagactgatacggagccacaatctcaggttcgacagcatggacttttcgactgtcgcggtccatgagaacaaaggtcgccatcatgtggatgagttcctgacctgcttcatcataaatgttaaagcgacggtagcaaaagagccgattgtagctcaaagcttccgtttcgatggtaatttcttccgcaaaacgaggcaaacgaaccacctcaatatcgtattctgtgataatccagaccagattatgctcttccaaaatggccttatcactaactcctaactcaatcgactgcatccctgaaacttgaagggatagcaaaatcacatctggaagcttgatatgaccgttcatatcagccatatcaaaaggaattttcattttcattcgataagttaagcccatcatctactccaaaataaatcgttctgctacggtgtctcctaaaaagagacctctttttgtcatacgaactcggtcaccatctatttgcatgagaccttgttgaaccaattctctgacaatttctccataaagtccatcaaaagatcttccaaatttttcctcaaatcgcgccatggagactcctgatttcttgcgaagccccaggaacatttcttcttccatttgctccttttgactcaggtgctcttctgtgatgcgcgcattgccttcctcaaccgcatttagataatgacgaatgggaccatgattcttatagcgcaccccattgacataaccagatgccccagcaccgatgccatagtattcagcattgtcccagtacatgaggttgtggcgactttcaaaaccaggctttgagaaattggaaatctcataatgctcaaaaccagctcgctccagctctgcaatgatgtactcaaacatctcagcttccagttcctccttaggcagaggcaatttccctcgtcgcatacggttcataaagaccgtatgattttccaaaatcaagctatacaaactcatatggggaatatccagcccaatggccttagccacattttccttgacctgctccatggtctggccaggcagcgcataaatcaaatcaatggagatgttgtcaaaaccagccagtttcaggcggtcgatattttcataaatatccttctccaaatgactgcgcccaatctttttcagcattttgtcgtcaaaggtttgcacacctagcgaaacacgattgacagccgagtttttcaaaacagctatcttatctgcatccaagtcgcctggattggcttcaatggtcaactcttctaagaaagacaagtccaagtttttagtcaagcccttcaataacacctccagttgagaagctgacaaagctgtcggtgtgccaccaccgatatagagggttctcaacttttgaatatcataagattgaaactcttctaacagatgttccaaataactatctaccggctgattcttgataaaaacttttgaaaagtcacaataataacaaatctgggtacaaaacgggatgtgcacataggctgacgttggttttttctgcatagtaattattataccacaaagaccggctacgagaaaaaaatcaccatccccagatacatagtccgtccagagatggtgatggtttattcttctgttatgtcaataacaatctcttctgattcatcaagagtttcagccttttcttgccattgctccttgagattattgaattgatcttttgatgcttctgtcgcttgacgaacacatgatttggcttgagaaaggacactgtccacagtgatttcacctgactcaacctgttctttagttttaagaacaaaatctgtagcctgctccttgacttctgtcagtttttcacagacctgctccttggcatactcaggatcttctctcaaatcatctagaaaatcttgagcctgactgcaaacttgtttgcccttgtcgcttgttaaaaacaaggcgagagctgcacctgaaacggttcctaaaaggattgaggatagtttacccataagaattctccttttttattttttgaaaaatttacttgctacacgaagagctgacaaacttgcaccagtcttaagtgtttttgaaccagctgaagaagctttcttgctcaagacacgcgcatggtcattgaggtctgaaacagatagagataaatctgccactgcactaaagagtggatcaatcgttgccaccttgacattgatatcatctgccaagacattgaccttagccagcaattcattggtatgatgcaaggtcacatccacatctgaagtcaaggttttaatcgtcttctctgtttcatcgataacacgtccaagcttttgtacagtaatgattaaatacactaaaaatacaatcaaagcaagggctacaagaatatatgcaacttctaacatttagttttcctcctctgaaatatagtaaggggccttctttcgattttgatatagaatgataaaaataccaagaccgataaggacaactgatagccattgagacactcgaagaccaaagaacatgagactatctgtccgcataccttcgatgaccatacgaccgaaaccataccaaatcaaatagaaagcagtgatatgacctcgtctaagactcttccattttcgtctgaatatcagaatcaaggcaaatccaagtagattccataaagactcataaaggaaggtcggctgacggtagctcccctcaatatacatctggtcacggataaagccaggtagataatccagattatccactgctgcaccataagcttcttggttaaagaaattgccccagcgccccaaactttgggcaatcatgacgctaggcgccgcaatatctagaaaatcccaagtattgatgagtttacgatcagcaaaaatatagagtacaagagccccagttatcaaaccaccgtaaatggccaaaccaccattccaaatggcaaaaatttctcccaagttctgactatagtaatcaaaacggaaaatgacatagtagagacgagctcctaaaatagccagaggaaaggctatcaagataaaatctaaaatatcgtctggtataattttctttctaggcgcttctttcatggtcaaataaaccgcaagaatcaagcctgtcacaatacacaaggcataccaacgaatggctagagggcctagatgaatagcaattggatcaagcattaggcacctcgttttgagcaataagatttgtcaagcgttcttcgaacaaacgcgtcgcatcaaagcccatttccttggcacgataattcatggcagcagcctcaatcacgacagagatattacgacctgttttaactggaatgcggatacgaggaatgcctacgccagaaatttctatttcctctgcattgtttccaaggcgatcaaaggtcttatgcgtatcataattttccaagtaaacagccagctggacttgtgaagaatccttgaccgcactcgcaccgtagaggctcataacatcgataatcccaaccccacgaatttcaatcaagtgtttcaagatttcagctggttcaccccaaagagtaatctcatccttggcaaagatatcgacacggtcatcagctaccaagcggtgaccacgtttgacaagctctagacctgtctcacttttaccaattccactatcgccctgaatcaagacacccataccatagatatccatcaagacaccgtgcacactggtacgttctgccaaacgagaatccaaatagctagataactctccagacaatcgactggtcgccgtacggctagttaaaatagcaatcttacattctctagctgcctttagcatctcctcaggaaccaccaaaccacgagcaacaataaccgcaggtgtctcaggtagaaacatttttttcaagacttggtaacggttgtgagaggacatcgaaacgagataggaccactccttcattcccaaaagttgaatccgctcaggcgtataatagtcaaaatagcccgtcatttcaagaccaggtcgcgtaatgtccgcggtattaatttccttttcaagtaattctggttcgccatagacaatgtctagtctaagcttttcaatcacttcttttactaaaaccgacatcatttcctccttcaatcgagttctttttactattatatcaaattgtccttagaagtttcagatttttgcaggctttgaagtatttatttatactcaatgaaaatcaaagagcaaactaggaaa

SEQ ID NO: 65 - DNA, 93022 bp, Streptococcus mitis NCTC 12261 contig11
tcatcatacaagtccaccttatactgcaggctgtagtctaaaccatgctctgctagaataggcaaatcacttttagcagcattgtagccaaccatgggtaaagaacccacaaactcttggaaatcttttataactttctccactggaggggcatcttttaatgtctcagctgtaatccctgtcaaaccattgataaaactctttagaggcacactagtatggacatatgaatcataggcagcgatttcctgaccatctctaaaacgcactgccgatacttgaatcaagtgtgtttgcccttcatgctgattaaattctaaatcgaaagcaatgtaatcttctaatcgttccattctatacctctcctatactgttattttatactaattcaaaccacgtcaacgtcgccttgccgtagatatatgtaactgacttcgtcagtcttatctacaacctcaaagcagtgctttgagcagcctgcggctagtttcctagtttgctctttgattttcattgagtattacttgagcaactatactatttagaaacaaaagaagccatcaggttagcatttaacctaaacagctccttgattatcctccaaataaacgagcaaaaaagcctttcttagttgattggacttcttcttttgcttggtccagctctagcttaagattttcttgatccttcatggcttgaagggtcaattgttgctgctgatcgagttgtttgtctttctcagcaatctgacggtctttgatgcgcatctgctcgtctttttctgataactgacgatccttggcttttaattgttcataaagacgaagaatttctgcattcttctcatcaaccagaatctccatcagttcacgttgcttgacatcttcactgacaggctcatcttcaaaaatcgtttttttatagatttcttctagcttaatcaagccacttctggtaacgactgttacccctttatcatttttatctgtgtcttcttctggtaattctttgacacggttattgattgcttggcgagataatcctaagacctctgcaatctcactgacggtcatttcaatactcataatatcctctgaaacgttttctagcttttctttacttaaatcttatcataagctagaaaaactgtcaaatttccgcttaatctaaagccttcaaaaaggctaacaagacttgggcagagcgacgtccagcttcgataataaactcatcaaaagagatgtttgcttcatggttggcattatcactcatagctcggatgactaaaactggaagattaagagcatgcgctgcctgagcaatagctgccccctccatctccacggctaaaacatctgggaaatgagacttaatcgcttctatcttgtcatttcctgcaacaaaactatctcctgtagcaatcaaaccaagatgccagttctggtccaattgagataaactctcttgaattttagcaataaaagttttatctgattcgaaataaagcggttgttgtgccatttgtccataagcatagccaaaagctgtgacattcacatcatgatagactaatttatcagcaatcacaacatccccaacagcaataccctctgctactgcaccagctgatcccgtattaataagagcatccacttgaaaatgatcagccaaaatcgccacactcatagcagacatgaccttaccaattccactttctacaagaacgacttcatgagaggcaatggttcctgtgtgataggtattccctaaaacaacttgctcttgggcattgtctaaatgctggaccagatacgccagttcttctggcatagccgcaataattcctattttcatttcaattccttttctattacaaaagtttcattgctaagacaagcaaaattaagagaaagatgactgcaaataagattttattcagtttagaattgaagacatttctcttggtattttcaatgcgacggcttttatgaatagacggttcgacctgaatcttcaaggtttcctggctaaaaccatgatccttaggattggcataaccaaaacgggaagaagaagttggtaaaatttttgtctcctcatcatctagcaaagggggacctgaaattttttcgcctctattagctctttcaatcatttcatccgttaataaaggtttacccatactgacctcctctattttttgtgcaattcccaatactgaacagccataattgtcttggcatcacaaatatgacctgattggatcaattccttggcttcttctaagctcacttcaagaacttccaaggtttcgtcttcatcctgcggacgcggatttttcacctttgtcaagtcgctcgctaggtatagttttaacttttcattacaaaagccaatggctgaataaaagtcatacaaaagttctaatttccctgtataggctgtttcttcctctaattcacgaagggctgctgcaacagggtctgtattttctcctacttccaactttccggctggaatttcgtaagagactgcctcgatagctttacggtactgcttgaccaagatgagtttttgctcatcggttacggctaaaacgcagacagctccattgtggaaaatcaaatcacgttgggcagttcccttaccttctggtaattcaacctggtcttgaaccagtttaaaaattggtccttgatagatttcttttcgactaagcgttttttcttcaaattccatgataggctcctactgattcttaggatgatgaggaaggcgagttgcatattcgtctttattgacctgacgtccacgaccaatagcaatagcatccgctggaacgtctttggtaatagttgaacccgcaccaacgagggaattgtcaccaagttctactggcgcaataatggttgaatttgaaccaacaaagacattgttaccaatgactgttttgtatttgtttttgccgtcatagttgactgtaatagttcctgcaccaaaattaaccttgctacccacttcacagtttccgatataagtcaaatgaccagccttagtattctcgccgatagaagaacctttcacctcaacaaagtttccaatatgaacttgggcacccagacttgaacctggacgaatgtgggcataagggccgactgttacgccgtcagcaacactgctttcctcaatcatagagttggtaatgacagctcctgctccgatagtgctatccaccacataagttccatttgtcaaaacagtctcagcaccaattttcgtttgcccttttaaggtaacattggcttcgatttgaacttcaggagcaatttcaacatcgatatcaatataagttgcttctggattgacaaagctaacgccattgaccatgtgttgacgattgatgcgacgacgcatcactgcttcagctgtcgcaagagccacacggtcatttactccaagactttcatcaaaatctttcaaagtataagcaccaactttttcaccagcttcacggaaaatgccaatgacatctgtaatatagtattcaccttgagcattgttggtattgatatttttcaaagcctcaaacaaacgctcgttgtcaaaaacgtaagttcctgtgttgatttccttgatttgtttttcaaaatctgtagcatccttctgctccacaatgcgaagaacctcagcattgtcattacgtacaattcgtccatagccaaaaggattatctgtttcagcagtcaagatagtcgccacatttttatgattgatgtggaaatcaatcaagtttttcaagctttcaccagtgattaaaggagtatctcctgcaatgaccaaggtgtgacctgacaaaccttctaagataggctctgtcatcataaccgcatgaccagttcccagctgttcagattgagtcacaaattctgtctgtccagccaagacctgctcaaccaattctgccttgtgtccaacaactgttactgtcttttcaggttggatagctcccacacttcggaaaacatgttccaacatggaaatacctgcaaccttgtgcaacacttttggcaaatcagatttcatgcgagttcctttacccgctgctaaaataatggcataatttgacataatcttctcttttctctagaaattcccttttattataccatatttcaaatcattccgcgcccttgaatgaaaaaatgctccaaagtcctttccttaacccattttttgagtattttttttgattttttttcatttttaaggtaaaattatgagatatgagaaagaaaattaatccgcttattttatttggtttttttgggattatgattttcattttaatcctgaatcgccctcgttttgaggaccatcctgtaaaaacaaagtcaaatatcgcgcaagtagaatcacaagcgctacataatatagataaaccggtaattgatgtttctggttggcaacgtcctgaggaaattaattacgatactctgtcgcaaaacatttctggagctattgttcgtgtccatagtggtgctcaaacgtccaaagagaacgatgcttcctatgttaatggtgttgataaggcctttaaaacccatatcacagagtttcaaaaacgaaatgtcccagttggtgtctatgcctatgtagctggaaaaaatgtccaggaaatggaaaaagctgctgaggtattctataacgcctcttcgccttacagtccaagttactattggctagacgtggaagaaaaaaccatgtccaatatgaacgagggtgttgaagcctttcgagcaaagctagaatcactgggtgctaaaaacatcggaatctacgttggggtctattttatggaagaacatagtattgatacagacaaatttacgtctgtgtggattccttcctatggttctgactcaggtttttacgagacaaccccaaaaactgatttagattacgacatccaccagtacacttctaaaggaaaaattgctggttttgaccatgatttggatatcaacgtcatctcttccttaaaaaacaaagaagaaacctttagaaaactctttttaaaaccataaaagcatttgtttagcatttgctttttctttttgtgtttgattgtgatacaatataataaggattttttgaaatagaaatagttggaggaaacatatgctctcatggttagcacgccttattaaagggattgtgattgctcttggatttatcctaccaggaatttccggaggggttctagcagcaatcttaggaatttatgaacggatgattggatttctggcccatccctttaaggactttaaagaaaatgttttgtactttattccagttgccatcggtatgcttctgggaatcggcttattttcctacccgattgaatacctgcttgaaaattatcaggtctttgtcttatggagctttgcgggcgccatcattggtacagttcctagcctcctcaaggaatcaactcgagaatctgaccgagacaagattgatttagcttggttctggacaacctttatcatctctggattaggactctatgccttaaattttgtcgttggaaccttaagtgccagctttcttaatttcgtcctagctggtgcactactggctcttggcgtattagttcctggcctcagcccatcaaacctacttttgattttgggcctctatgctcctatgctgacaggttttaaaacctttgacctcttgggaaccttcttcccgattggaatcggggcaggtgcaactctcatcattttttcaaaattgatggattatgccttaaacaactaccactcacgcgtctatcatttcatcatcggcatcgtcctatcaagtacccttttgatcttaattccaaatgcaggaaacactgaaagtatccaatacactggtatttctcttgttgggtatgtcatcatcgccttcttctttgcgttgggaatttggcttggtatttggatgagccaattggaggataagtataaataatggacaaaaaaagttaaaatcaaaaaaacattggtggaacaaatcctgtctaaggcaggtatcccacatcagggtattcaaatcaatgccctggaaggagagcttcctcaaggttatgaacgagatcagattttcaaaaccttggctcttttgggagataaaacaggaccaattatcggaattgtccctatcactcaacacttgtcggaaaagaaactagccaaaatttctggcaataaaaaagtgagcatgattccacaaaaggacttggaaaaaacaacaggttatattcatggagccaataatcccgtcggaattcgtcagaaacacaattatcccatttttatcgataagatcgctctagacttggatcaaatgattgtctctgcaggcgaagttggtcacagcattatcgtcgctccgcaagacttggctagctttgtaaaagctgactttgcagatatcttggagggtagccaagaatgaaactctactttgtccgccacggtcgtaccctctggaaccaggaaggacgctttcaaggtgctagtggagattctccccttcttcctgaatccattgaatccctaaaacaactaggccagtatctcaaggatattcctttcgaacagatttattcaagtgatttacctcgagcggtcaaatctgctgaaattatccaaagtcaactccagaccccctgtcctttagaaagtgtttctaatctctgtgaatggcagctggggaagttggaaggtttgaaaattgcaaccttggaatctatttaccctcaacaaatcaaagcttttcgatctaatcttgctcaatttgacactcaaatgtttggagccgaatccctctatagcaccacgcaacggaccatccaatttatcaaatcattaaaagatagtccagctgagtgtattctaattgtcggccacggtgccaatcttactgccagtctccgtactcttttaggttataaagaacctcttcttcgtaaagatggcggtctagcaaatgccagcctgacaattttagaaactcatgattttgaaacatttacactcgatacttggaatgatacttcctatcaataacagaacttgattttagcgtcaagttctttttagttttgaaagattatccgtgaatttcttgcttatttatgataaaatgggagtatcgcaaaaaatgactcatcgtattcaattttgagtaaaactaggaggatcccatgtcaacagaacatatggaagaactaaatgaccagcagatcgttcgccgtgaaaaaatggctgcgctccgtgaacaaggaattgatcctttcggaaaacgttttgaacgcactgcaaattcacaagaattaaaagataaatatgctgacctcgataaggaagaattacatgataaaaacgaaacagctactatcgcaggacgcttagtaactaaacgtggtaaaggtaaagtaggatttgcccaccttcaagaccgtgaaggccagattcaaatctacgttcgtaaggatgctgtcggtgaagaaaactacgagatcttcaaaaaagcagaccttggtgacttccttggtgtcgagggtgaagtgatgcgtacagatatgggagaactctctatcaaggcaactcacatcacacacttgtctaaggctcttcgtcctcttccagagaaattccatggtttgacagacgttgaaacgatttaccgtaaacgttaccttgacttgatttctaaccgtgaaagctttgagcgttttgtcactcgttcaaaaatcatctctgaaatccgtcgttaccttgaccaaaaaggattccttgaagtggaaacacctgttcttcacaacgaagctggtggagctgctgcccgtccatttatcactcaccacaatgcccaaaacattgatatggtgcttcgtatcgcaactgagcttcacttgaaacgccttatcgtcggtggtatggaacgtgtctatgaaattggccgtatcttccgtaatgaaggaatggatgctacacataaccctgagttcacttctatcgaagtttaccaagcttatgcagacttccaagacatcatggacttgactgaaggcattatccaacatgctgctaaagctgttaagggtgatggtccggttaactaccaaggtactgaaatcaagattaacgaaccatttaaacgtgttcacatggtggatgctatcaaagaaattactggtgtcgatttctggccagacatgactttggaagaagctaaagctatcgctgctgagaagaaagttcctgttgaaaaacactacactgaagttggccacattatcaatgccttctttgaagagtttgttgaagaaaccttgatccagccaacctttgtctatggacatccagtagctgtatctccgctcgctaagaaaaatcctgaagacgaacgctttactgaccgtttcgagctcttcatcatgactaaggagtacggtaatgcctttactgagttgaacgacccaatcgaccaacttagccgttttgaagcccaagctaaagctaaagaacttggtgacgatgaagcaaccggcatcgactatgactacatcgaagctcttgaatacggtatgccaccaacaggtggtttgggaatcggtatcgaccgtctctgcatgctccttactgatacaacaactatccgtgacgtattgctcttcccaacaatgaaataatcacttatcctctggctcttgtcaggggatttttcgatgcaaaaagagattgaggaaaactcaatctctacttttcacttctttggttgctacatcttctccaaaccatttttggctaatttcttggaacttcccttctttgtacagttgaacaaaggcttggtttaaagcttgtagtaatctcttgtctgctggtctaactccgactgcaaaggattcactttcaaatcctgctgaaaagacattgtagtcacttaatataccttcagactggagatagtaattagcatacactcggtcaatcaacaaggcatcaatccggtcatttttcaaatcaatcaaggcctcattaaaactctggtactgattagccttctgatctttgacacgatttttcaataaatctggctgggcttcaaagtctaaataaccagaggaaccggcttgggctcccaaggttttatccttcatatcctctactgaacgaatctgctggcttttctttgcaaccagaacttgctgattttccatataaggaatgctaaaggcaaccttctctcggcgttcatcagtggcagcatagccattccaaatggcatctatggttccattttgcagttccgtctccttcatatcccagtcaattggctgaaattgcaccttgacacctaatttttcagaaactgcttgtgctaaatcaatatcaaagcctgtatattggccattcttttcttcaaaacccatgggtacaaaggtattgtcaaaaccaatagtaatggtcccctgctcttgatacttatcccagttatccttctttggatcactagctttctgagtacaagccgttaaaaagagggtcaggagcgaaaccaatactaaagcaattttcttattagtcattggcacctcctacttgggttcaaccttgagaatctgatctgcgatattttcagcaaactgcaaatcatgggtaaccacaatctgggtcatgccaagttccctattttgcaagatcagtttttccacttccaagcgtaattcaggatctagggcagaagttggttcatcgtaacctatgatttctgggtcaatcatcatagcacgcgccaaagctacccgctgcttttgcccacctgatagtgagaatggataagcatctgcatgtcctgccagtcctaattgttccaaaagacctcgcgccttcttctctgcctcatcccgcttcattcccatggttttcacaggagataaggtcaaattatctagaacggataaatgagggaaaagttgaaaatcttggaatacaaatcctagtagattgcgcttctcaagttcgtccaattctaaaggttctccattataaaagatttgccctgaatcaatggtttcaagacctgcaagcatacgtaagagggttgtcttacctccaccagaaggtccaacgatagctaggatttgcttttcaggaatctttagactgaaattagacaaaatttgcttttcaccaaagcctttattgatatttcgtaattctaacatggcagcctcctatctatagtaactgtacttcttctcaacttttttggcaagaatggtcacaataccaatcaaaatcaagtaaatggctcctgccaagaacataggaaccaggctagcatcacggtttgcagctgtacgactagccaagataaggtctgaaattcctagagcatagaccagagaagtatctttgaccaaactcatgacttcgttaaatacgctaggaagaacaatctttgtcacctgaggcaaaataatatagcgaactgtggcaaaaggactgaacttcaagaccttagcagcctcatattgaccgttaggaatggtatcaatccctccacgaaagatttcagcaaagtaagccgcataattcagaacaaaggcaatgatagctgcaggaagacggtccaaacgaatcccaatacttggaagcacataataaataaaaatcaattgcaagagcaagggtgttcctcgcataatccagatataaatattaatcagatgatggaggggcttccaatggacttgcaaggcaaaggcaatcaaaacgcccaagggaatagaaaaaatcaagaccagtgcaaaaacctgcaaagtcatgcttgcaccgctcaataaactcggtaatatctcaaacaaataagacatactgcacctcctaaaaataatagatactattatagcataaataaacaaaacaaccaaccatttttgtaaaaaaattctctttaaaaaagaaaaaactatatctatcaaaaatgattagatacagtttttaaaaaaatattcttacaatctctcaaatagttcttgcatttgtacatcatctggaactagttttaagtaagtttgagcattgactttggcttcctcaaagtagcccaattcacgcaagagatagatatagtgttccagaaactctggattgtcctttaaatctcctgccaactcttgataatgctcgtaggcggtatctaaatcgtccatttcttgataagaacgagcaatcatccacttggtcaaaagattctctggctcatcattttgcaagtctagaatgtcctcataacgttcctgttctagataaattgtggctagacgaagtaagatttcttccgtatcctcagcatcttcttttgcagtaaggaggtagttttctgcaccactggcatcatgcagttcataagagaattgtgaagcagctagcaagagacgagtttcaaagggatttttctccaagccttgcttagcgatacgcagggcttcttgaacctgatgttccttatgcaaggcctgactataaccatactcatagccttcaaagtcaggagaaatggtatcaagctgcttaaagtagaggacagctttttggtattcttctcgatcaaagtaaagactagccaactcaaaagctgttaggtcatcgtattctaactctagggctttttctaaaaactctgtagccgtttcaaatttccctaactgtgcataggcaaagccaatccgttgataggtagaaatgcctgtttgctcataaatagtacgattatctaactgagcatagccttgaatggcctcttgataattttccaactcactatccaactctgctaatcccaatatcaagagaggatcctctgaataactcaaagcctccagcaatttctcacgcgccacatctgtcaaaccttccaactggtaaaggtctgccttaagtgccaaagccgaaacataccagtcactgtcagcttggaattcctcaaggtaggcaaatgcttcctcgatttgaccatcctcgctagcaatagttgctagattaagattaacctctggaaaatcttctacgattttcaggtaaatttccttggcctgaggataaaaaccaatcccttctagataggtggctaactcatacagaaggtcacttggatcattttctaaagctttgacgaaataatgttctgccttaactaaatcttgctcttccaaagcctgtaacatctgttgactattgttcactctttacttcctctccttctagttcatataggccactgactaccttataccattcgaaaatggctgaaatgacaactttagcagaagcataaaccggaataccgagtaaaactccccagataccaaacatggatcctgaagttaataaaacaaagagaacattaatgggatggatgtttaattgacttcccaaaatcaatggagagacaaaacggccttcaatagtttgttctacgataaagacaatcactacttttaaaagcatgactggcccagcaatcaagcccaatactagggcaggaagcatggctaagaagctacccaaataaggaaccagatttaaaataccagcagtaacccccaaagtaactgcataacgtagaccaataatcttgaagaaaatcataaacattaccgcaacaataatagccactgttacttgtcctcgaacatagttggacaactgttgattcacatctgataaaacctgcccaacaggttctttcaatttcgttggcatgaattgggtcaaatagtgacgtaggccttttccatcacgtaagagataaaagagcatgaacggaacgataatcaaggcaacaatcacttgagaagcaccgctaataaaggcacttacccagttgactgcctgagaagaaactttacttgcccaaactgtagcctgacttgaaaagtttgtcaaaacttgttctaactgaggtctgaaatcatctggtaaacgcttggttaccaaatcatcaataactctatctgcatcttcaaggtagattggtacatttcttgcaaatgttaaaacttgacgttgtagatttggaatagctactgccaagccccaaatgataaagagtgcaataatgacaaagacaatactgatggctatgacacgattgactttgtgtttttccatccaatcaacaatgggattcaataaataatatagcaggccagataaaatgactggcaacatcacaactgctaaaaagtccaaaacaggtgaaaatagaaaactaatcttacttaaaataaaaagattgagtcccaataataaggttaccaaaaataccgtaatggccttgttgtccaaaaaccacttgaaaaaccaagataggctaaaatgtttctctttttgttccataaataattcctttctgtcattctttcattataccatttttagagcaaaataactcttttttaaagtgcttacataccattgaattgtaccgcatatcatattgtgaatctattttgtgatataatagtattatctttataaagaggtatagtcatgaaagaaactgtttattttggaacttacacacgtcgaacttcccaagggatttacaaggcagactttgatacagaaactgggcagctttcaaatctagaactttttgtcagctgaaccaagtccaacctaccttgcctttgaccagcaccaacatttatacactgttggtagtcaagatgataaggggggaattgcagcctatcaaactgatggaaccttattaaatcatgtcgtggaagaaggagctccccactgttatgttgccgttgatgaaaagcgtgatttggtttacgcggcaaactaccacaagggacaggtccttgtttataaacgtcaggaagatggtcgccttctacttagcgatgtggatcaacacagtggccaaggtccgcatgagaatcaagcttctccccacgttcactttacagatttaacacctgaccactatctagtgacctgtgatttgggtactgaccaagtcatcacctatgaccttgatcaagaaggaaaattatctaaactctatacctatcatagccagccaggagcaggctcacgccatattattttccataaccactataaaattgcttatctgatttgtgaactcaatagcactatcgaagttttaatctacgatggtgttggcgaatttgaacgcatgcaagttatttcaactctaccagaaggttacgaaggttttaatggaactgctgctattcgtctctctaaagatggtaaatacctctacgcttctaaccgtggtcatgattctatagcagtatatacaattcttgcagacggtagcttagagttgttagaaatcgttccgactcatggtcagactccacgtgattttgatttgacaccagatcaagaatttgtcattgctatccatcaagactctgacaatgcaaccgtctttaaacgcaatcctgaaactggtcgtctagcagaactttccaacgacttccatgtcccagaagcagtctgcatcagttttgccccttaagaaaacataaaaaatgaacttggtaactcaagttcatttttttcttatagtctatttccgacattaatacggttaatggcacgctgcagtgcaatcttcgcacgacgttcttggtcaatcaagtgtttgtcttgtgcttcttcaatttcacgctctgctcgaagtttggcacgttctgcacgactaacgtcgatatcacgagcacgttctgcagagtcagcaacaattgtgataacgccattggcaacttcgataacacctccgtttactgcaatccagttcacgtgattttcatcatctacacgtttaaccttaacctcatctactgctaaaactgcaatcatattttcatgtcgtggcaagattacccatctcaccatccagagttcgaactgatacaaagctggcatggtgatcatagacgagaccatctggtgtcacgatctggacagttaactgagccatagatcacctcttaaaatcccattttttcagcttttgcaatcacatcttcgatagaacctacaccacggaaggcatcttctggcaagtggtcgtgtttaccatcaaggatttccttaaagccacgaacagtttcagcaactggaacataagaacctggctgaccagtaaattgttccgcaacgttgaagttttgtgacaagaagaactggatacgacgggcacgagcaaccaaggtcttttcttcatcagaaagctcatccataccaaggatagcaatgatatcttgcaattcatggtaacgttgaagaacgcgttttacttcagcagcaactgcatagtgctcttctccaacgatttcaggtgccaaggcacgtgagcttgaagcaagtgggtcaacggctgggtaaatacccaattgtaccaacttacgttccaagttagttgttgagtccaagtgagcgaaggctgttgctggcgctgggtcagtatagtcatccgctggcacatagatagcctggatagaggttacagaaccctttttagttgatgtaatacgctcttgcaattgacccatttccgtagcaagtgttggttggtaaccaacggctgatggcatacgacccaaaagggcagatacttctgaaccagcctgagtgaaacggaagatattatcgataaagagaagcacgtcttggccttccacatcacggaagtattcggcgattgtcaaaccagttagggcaacacgcatacgtgctcctggcggctcattcatctgaccaaataccatggctgttttctcgataacacctgattctttcatttcccagtaaaggtcattaccctcacgagtacgttccccaacaccggtaaatactgaaataccaccgtgttcttgggcaatgttgtgaatcaattcttggattaagacggttttaccaactccggcaccaccgaaaagtccaaccttaccacctttaaggtaaggggcaagaaggtcgataaccttaatccctgtttcaaggatttcagaagaggtagacaattcatcaaaagttggagcttttttatgaattggctgacgctctgcatcttctgtaaaaggagcttccaagtcaatggtatctcccaaaacattgaagacacgtcccaaagtttctttacctactggtacagagattggacgacctgtgtccaatacttccattccacgagtcaaaccatctgttgattccatggcgatagtacggaccataccatctcccaactccaaggctacttcaaggacgatttttgtttttctttcgtcatttttgtagacgacaagtgcattgttaatctcaggaagtttttcccctgctgcaaacaagacgtctacaacgggaccgataacctgagcaattttacctgaactcatctccttctcctattctatataagatactgtcggttcctagcttacctaggtcctaagttcattttcatacgagctagactagtggctattctaaggcactagctcctgctacgatttctgtaatttcttgtgtaatcgccgcctgtctggcacggttatactggattgtcaaatcattaatgactttcttagcattatctgtcgctgtttgcatggctgtcatacccgcagcattttcagctgtcttagcgtcgataatagcaccgtaaatcatactttctgcaaactgaggcaacaactgctccaaaatttcttctcggctagtttccaattcaaaggtcaagctgtaactgtcatctgcttcatttggatccaagtcaacaatcggaagcatttgttccacacgcatttgactagttagcgtattgacatgatggttatagcagacatagagttcatcaaaaagttcattttggtacatttcaacagtttttgaaataatcttacgaacttcatcaaagcttggttgatctgccaagccacgtagttcataaagtggttgaataccacgagctttaaagaaatcagctcccattccaccgatacagatcatttcaaaacctttaccatctggatggtattcttctttcagctccataacggctttcaaaatagaagaattataacctccaaccaaacctcggtctgatgtaatgacgatatagcctgtcttcttaactggacggctaatcaacatcggattggttgaactaccagctccattcccatgaagaatatccgtcaaaagtttacgaactttctgagcataaacttggaaattgcgagcagcttcttcagaacgacctagcttagcagctgataccatctgcatggcattagtgatttgactcgtattttttgttgaggcgatttttgttttaatatcatttagagatactgccatctgacacctctattcttattggaagctggtttgattgagaaactctgtaatcgcagcatccaagactgcttcttctggcaagtcttttgtatcacgaatggtttctaaaatctctggatgttgagcgtcaaagaaggcatggaactcttcctcgaaacgaacaatatcatctactggaacagtatccaagaaaccatgtgtcaaagcatagagaatggttacttgtttctcaacaggtaatggtttgtgaacaggttgtttcaagacttcaactgtacgacgtccacggttcaacttagcctgtgttgccgcatccaagtcagaaccaaacttagtgaaggcttccaactcacggtatgaagcaaggtcgatacgaagtgtaccagcaacctttttcatggctttgatttgtgcagaaccacctacacgagatacagatgaacctgcatcgatggctggacgaatacccgcattgaagagaccatcaccaaggaagatttgtccatcagtgattgaaatcacgttggttgcaatataggcagagatatctcctgcttgtgtctcgataaacggtagggctgtaatagatccaccaccaagttcatcagaaactttagctgagcgctcaagcaaacggctgtgaaggtagaaaacatcccctgggaatgcttcacgacctggaggacgacgaagcaagagagacagttcacgataagctaccgcttgttttgaaagatcatcataaacgatcaaaacatgcttcccttggtacataaattcttctgccatggcaaccccagcataaggagctaggaaaagcaatggagatggttgtgaagcagaggctgtcacaacgattgtgtagtccaaggcaccgtactgacgtagtgtttctacttgcgtacgaactgttgactctttttgtccaatcgctacgtagatacagatcatatcttgacctttttggttcaagattgtatcaatcgcaatagttgttttccctgtctgacggtcaccgataatcaactcacgttgaccacgaccaatcggtacaagggcgtcgatagctttcaaaccagtttgcaagggttctgatacagacttacgttgcataacaccaggagctggcgcttctactggacgagttttgtcagtgtggatttctccaagaccgtcaactggacgaccaagtgggtccacaacacgaccaatcagactttcacctactgggacttccatgattttacctgtacggcggattgtatcgccttcacggatatctgtaaagtcacctaggatgataataccaacgtctgttgactccaagttttgagccatcccataagagccgttttcaaaaatcaacaactctccactcatggcattttcaagaccgtgagcacgcgcgataccgtccccgatataggttacaacacctgtttcagtcacatcaaaattgggtttgaaattttcaatttgttgcttaattaaagcgctgatttcttgtgcgttaattgccaaaagaacaccactttctatttcaaattttctttaacaactttaagttgttgtttaatactcacatcaattgtcttgtgattggcaaaaatgacaaaaccaccaataagactttcatcgatttgttcttttacactccttactttaagagacatttttttctcaatcaaagggagcaagcgactcttctgttcatcagttaaaggatgagctgacctaatcgtcacttcaaatcgatttgtttctttttcaagtcggttcaagcaatctacaagaatatcataaaaaagatttgctctatgattgtagataagaacctggataaagttttgcaataaagtcgacactgaatcttggaagaacgcaatcgttttttccttgtcagactcgtctactgccactttttttaaaaaagaaggtaagcctgtttcttcagcaacttgcttgatttgagctaagtctgaaaagatacggtcttcttctcctttttctaaaaccaattggacaaaaggcatgctgtatttttcaattacctttactgttttcttgtccattaagcttctcctagctgatcgatatactgatcaatgagttctttatgggcatgaccgtcaaggttttgtgagatgattttaccagccaagctgattgtcaaatctgctacctcacccttaacgctttgtaaagcttcagctttattttgagcaatttcttggttcgctttttctttcaagcgtcctgcttctagcttagcatctgctaaaatactagctttgcttttctcagctgtttctttcgcattctcaatgattgtcttagcttctttacggctaccagccaattcatcttcgcgtttctgagccaatacttctgctttttgacgtgcttgttcagctccgtcaatatctgctgcaattttttctgctctttgttcgaaaatgctagtcaaatttgaccaagcgtatttcttaaccaagactagcaagagaataaaggaaccagcgattagtataaaatcaccaagtaattcacctactgttacattcataaactactcctttctattcttcatcattaattttatttcctaggtacattgaagataacaatgtaaatacatatgcttgtacacaagaaataaaaacagaaaatgcagtccagattagatttgttccaaaagcaataggataccaatagaaggcctgatgagaaagtaggactaacatacttgccatcacttcccctgcaaagatattaccaaatacccgcaatgcaagtgaaaggagattggtaacttcttctaagagattcattggtgtcataaaacctggtgttacaaatgcttttaaatactttttgattccacgacgacgaattccttctacgtgggtcattaagataattgtaaaagacaagaccaagtcaaatgacaaatttgctgttggtgaggtccaaagatttacaccatctgtagtctgaattctagccattaagccaatattatttgcaatggccataaataggaataaacagaaataaaagagagaataatcctttatcattggaccaaggtttgattttgtaaatccaacaacaaaatcaaataaatactctaatacattttgttttcctgtgggtctcaaagtcatatttcgagttgcccaataaataaagccaaaaataagtgctacagtcaacaaagtcaaaactactatggttaaattaaaggtaacaggaccaatattgatggttggattaatactttcttccatctaaaatcctccctttttcaatttatacttcttttatttgatgataaatgaaaagacaagagtaacgaagaaagtaccttcaataaaggcaacccctaggatcatcaaactacgtagttctgagatgatatctggttggcgagcaactgatttcaacaaaccgttcatcaacaaaccttcaccaagagatacacccatacaggcaagacatagaccgaaaaatgttaaattcatgacgaattctccttttaattaaaatttacttacttagtttagtcctaaaaattggatttgtcaactttttacttacgttgaaagcgtttaatgaaaattatttacaattttactatttttaagtctattatatagaaaactttggaaaaaacttgtaacaaatccctccattatctaggtctttctgaaaaataatgaaaaatccgagatgacatctcggatggaaattaatatattttctttaacctaatgctctttagtaagtaggattaaagggaaagcaactagaaagctttcgtctcctgcatgcttattaagcacgaactgtgacgctggtgccatcttccttataaagattgataagtccttctttgagagctcgaaccatatctccagcttgaacaggttgtggaaccttgatagtcaagagttccattggatttggagcgcggtcaattttattgcctttggcatcatgtaaatcttcgatatacgtttcaaaatgacggaaacctgggccataaaactcaacttggtcgccttcgttaataacgttccgttgacgaatagttgctgtttgtgtcgcatcatcataagaaaccacttcagcaacaaacttgtactcaggaattttacgacgagcaccaaacaactgctcattttcagatggtgtaccgtaatagaaacctgttgctaattcacgttgggcaaccttccacatctcatccaccaagtcttgtttgatagcttcaaacttttcaggactttcaagatatgcatccacagccgccttgtagcagttggttactgttgaaacatagtgaatagacttcattcgaccttcaatcttcagactgtccacaccattttcaatcatatctgggatatggtcaatcatggacatgtcaacagctgacattgaaaatgcttctgggatttcccctttcaagctcttacgttctttcccaaatggcatatcataaagatcatacttccaacggcaagactgagagcaaccaccacggttagcatcacgcatactcatgtggtttgaaagagtacaacgaccagagtaagaaatacacatggctccgtggacaaaggcttcaatctcaacatctgtacgtttgcggatttcagctaattcttccatcgaaacctcacgcgccaaaacgacacgagtcaagcccagttctttccagaactcaagggtttcatagttagttgcacttgcttgagtagagaggtggatttcaagacctggtgcttcagtcgctgcaatcatgatcaaggctgggtcagatacgataactgctgcaatcccgatatcacgcagtttacggaaccactcaccagcaccagcttcatttccttcgtgcataaccatattggcagctacatagactttggcaccgtacttggcagcaaactggacaccttcttccatctgttcgaaagtaaagtttccggcacggctacgaagaccataggcctgaccaccgataaagacagcatctgctccatattgaacagctacctttagcttctctaaagtccctgcaggtgataaaacctcaggacgttttaatgtttttgtcatgttttctcctatttgcaatataaaagtttgacgtttttccttctcattttatagtaaataagccataaaatcaagcctagacagattgttttgacaattctaatcttttagattattaaagcaaaaagattgtcaaagagaaaaagcccacagatgtgagcccttttctaatataggttaggaaaactatttctccacttcttttttcttgtgtgcaagaaatccaaatccactcaaaactcctagaagtcctaagactacaagattagcatgatcttctgtacctgtattaggcaattcctctctcttacttgctacagaagtcggaatttgtgaagtttcttttgtcgattgttcagttggtgtctttgattttggtacttctacctttggtgtctcaacctttggcgtttcaacctttggtgtttcaacttttggtgtttcaacttttggcgtttcaacctttggtgactcaacctttggtgactcaacctttggtgtttcaacttttggtgtttcaacttttggcatttcaacctttggtgtttcaacctttggcgtttcaacctttggtgtttcaacttttggcgtttcaacctttggtgcctcaacctttggtttcgtacctactgtgataacttcttctactgcttcttcagtaatcgtggttggttcattcggtgttactgctcctgtattaggatccaaggtataagttgtcgtagtagttgttttaccagctttaccaggtcttgttacttcacgataatctttatcttttgtattatcttctacataacgtattgtatatggagtagttgtttctacaactgttggtttcgtacctactataataacttcttctactgcttcttcagtaatcgtggttggttcgttcgatgttactgcacctgtattaggatttaaggtataagttgttgtagtagttgttttaccagctttaccagttcttgttacttctcgatagtctttatcttttgtattatcttctacataacgtgttgtatatggagtagttgtttctacaactgttggtttcgtacctactttaattggtttcgtacctactgtgataacttcttctactgcttcttcagtaatcgtggttggttcattcggtgttactgctcctgtattaggatccaaggtataagttgtcgtagtagttgttttaccagctttaccaggtcttgttacttcacgataatctttatcttttgtattatcttctacataacgtattgtatatggagtagttgtttctacaactgttggtttcgtacctactataataacttcttctactgcttcttcagtaatcgtggttggttcgttcgatgttactgcacctgtattaggatttaaggtataagttgttgtagtagttgttttaccagctttaccagttcttgttacttctcgatagtctttatcttttgtattatcttctacataacgtgttgtatatggagtagttgtttctacaactgttggtttcgtacctactttaaccacttttggtaccataggagtttctttttcagtcggcttaccgtcagttacaataccatcaagttcattcacaattttaggtgttgtagttacaattttaccttcgctaccgttcgattcaacaatttccgtaccatagtcgattgttttgtcttctacataagttgttgtaattggaatttttgtttctgtttctacaggtggtaagttattctcatacttctgtttatacacataggtaatgacagtttcacctttcacaatctctgtaatatcttgtttgtcttgttctttaaaggtataacgcttgttctcaaagtccaaatcggtcggatgagttaaagatacatcagaacctacttctttaagttcagatttaacactaggtgcaatttcaacaccttgttcgtttacaaacttctgagtcactaaacctttgttttgaacttctgtataagtaacagtatggaaagtgcgagacacaccgttgattgctttttctgtatctgtcaattcaactctttggagatttgatgcataaacaatgcgaggtgtaaactgattacgtttattaggaactactttactagcaatgtactctttttgagaaattgtattttctccaagtaaagatgtttcttgtctataagtgtaatcagcaccagctgaacgtacttcaaactcggataatttagattttggaatatcagaagacgttataacccctttacccttaaaaccttggacatctaagaattttgcatataaatctttaattggaataatatttccttgcttatccttataagtataagttcgagtataaccaatgaaatcagtatgattttcagcacgtcgagttaagtttttaataattacatgagtctcaacaggtttactgctaaatgtagcgtaaagtttggtttcttcaggtagcgtatactcaaatttagcagttgtctcaatactaccgataccgtaaatactagataaaacactatctgaacgaggtgtgatggtgtaactatacacagtgtttggagttagttccactatacgagcaggatacccgatattcacacgatttgttgcatatttatctgtaattccaattcgagcaggtaccttaataaatgtttctgtaacttcctcagtagttggtttcgatactgcattatacaaaccttgagaatcagttaactccaattcattcgctttcaaataccgaatttcaccgctacttgatgtaatcgggctaactgacgcttctttcgagacatcttcatcgatatctcgactatttacctgagaaactaatctagcttttactttaatataattagcattgataagagtatttttaaactcatcaatcttcgttctatccgctttcacttgctcttgttcagcttttgcagactctaaatcacgaatttgagcatctactttctcttcggcagttgtgcgtaaatgtgtaacctcagaagaactatttgcaacacctacattttcagtgggtgtttctgtaaccttaacccctaaagcttttacttcttcaactttagcttttaactcggtttcttttaccgtatgtgttgtactcgtttcatactcactttgaaccacagtttcgctaggtggagtctgtgctgcattaggaggtgtacttgaatttggctgttcatcagcgcttacaatcccatttaaaaataaactccctaaagcagtcgttaggataataccacttaacaaacctaacttagttttacggagatatccatgacctttttcttgttttactgctttatgcaatagaaacaccaactttcatttatttgtattgttaatattattacataattagctaaaaaagtaaaggtctcaactcaagaattaaatacaataaatttataaaaacttcctaactactatactagaattttctacaattcaaaaaacaatatcagaacggattgatactgatacgaaacaaaaaacaaaatgactctttatacatctatagtaggattcaagacagattatttatttcttaatcgatatataaaaggaatcctgattaaactgtctttaaaacttaagaaatcaaggatatgataaaaggaatggatatcagtatatctatttttaccatctcaaaagtagatccagagaatataactgttctcttatgatgagactttggaggcaaccattctgtcttgttttatgaaagaatagcttaaccttttacttaaaatattcagataaaaaaagagagaacgattttgttctctcgaaatccttatttttcatttactataagagtaaagtatttatagctttactcccactcaactgttgcaggtggtttacttgtaatatcatagacgatgcggttaacgtggtccacttcgtttacgatacgtacagaaatcttttgaaggacatcccaaggaatctttgcaaagtcagctgtcataccatcgatagaggtgatagcacggattgcaatcgtgtagtcatatgtacgaccgtcacccataacaccgactgaacgaacgcctgtgttcactgtgaagtattgccagatatcgcggtcaagacctgctttagcaatttcctcacgaaggatagcgtctgattcacgaacggtttctagtttctcttcagtgatttcacccatgacacggatagcaagtcctggtcctggaaatggttggcgccatacgatatggtctggcataccaagctctgtaccaagggcacgaacttcatctttatagagagtgttgagtggttcaatcaattcaaactgcatgtcttctggaagaccacccacgttgtggtgtgacttgatagtttgagctgtatctgtaccagactcgataacgtctgtgtataaggtaccttgagcaaggaatttcacatctttgagcttacttgcttcgtcatcaaagacatacacaaattcgttaccgatgattttacgtttttgttctgggtcagaaacgccagcaagtttatcaaggaaacgtttagcagcgtctgctttgacgatattcaaaccaaacttaccaccaagcatgtccataacttggtccgcttctcctttacgaagaagaccgtggtctacaaagatacagattaattgattgccaatagccttttggagaagaaccccaacaactgaagagtcaaccccacctgatagaccaagaaggacacgtttatcaccgacggtttcacgaattttttggatctgcatatcaatgaagttatccattgaccagtcgcctttagccttacagatgttaagggcaaagttacgaaggatgtcattcccgtatacagaatggcgaacttcagggtggaattggataccgtaaatgtgtttatctgggttttcgatggctgcgtatgggcagtcagctgatgtacctgtacgaacaaagtcagcaggaatttcagtaaccgcatcaccatggctcatcaaaacagtctgctcgtctggtgttgattcaaaaagagctgatgatgtgtgagtaagagttgattgaccgtattcacgatttccagcatcacctgcaggaacaacttttcctccaagtttatgggtcaataactgcataccataacaaattcccaaaataggaattccaagttcgaagatttctgggtcaatatcaaatgaaccatcttcgtatacagagtttggaccacctgaaaggatgattcctacagggttgatttcacgaacttcagcagctgaaattttatggctttttagttctgaaaaaacaccaatctcacggatacggcgtgaaatcagctggttgtattggctaccatagtccaatacgatgattttttctacatcttgcaaatcagttgaaatgttgctcatctttttcctttctcaaaagaaatatcttttttcaatattctatcacaaataagggcgaattaccaactaaacaaggcgaagtttgactttttctagtttattggggtacaatagagaaaagatagaaatgaagtgaaaaatatgctacccgcttatatgaaaatccatgatcagattaaaaaggatattgacgaacatcgttgggctattggtgagagacttcccagtgaaagagatttagcagagcagtttgaggtcagtcgcatgaccctccgacaagctatttccctcttggtcgaagaaggagttttagagcgccgtgtaggaagtggcacctttgtatccagtacacgtgtacaagaaaagatgagagggacaaccagttttactgaaattgttaagtcccaaggtaaagtaccctctagccaactcatttcctacagaaaaaccattcccaatgaacaggaagttgccaagctaggaatttctcctaccgaaaatattatccgaatggaacgtgttcgctatgccgaccaagttcctctggtttatgaagttgcttctattcctgaaaaattcattaaggactttaaaaaagaagaaatcaccagtcatttcttccaaaccttgcaaaaacacggctaccgtataggcaaatctcaacaaactatttatgctcgccttgctaaagaaaagattgcccactatttggaagttgaaaaaggacatgctattcttggtttgactcaggtttcctacctagaagatggtactgcttttgaatacgtaaaaagtcagtatgtaggcgaacgctttgaattttatcttgaaaataattagattactatgcaaaaactctctgtcacggacaaagagtcttttttatttctctaagagtaaatctttcaaagaaatcagagttacagcaaacaatatcattgccatgccaagaaaatcaataggataaaattgttcattcataattaggaaggcaaagaaaaccgccgagattggctcaattgaagccaacaaacttgacttgaccggtccaatcagactggctccttttaagaacgctgtataggcaaagacagtcccgataaggataatgcctgcaaaagcaagaagaaaatcaagactagttgggatagcagtctgtagaactcctgtaaaaggaagggcgactaaacctgctatgaccattcccacaccaatgaccaaactactcccccacttcttaatcaaggctatgggcaaaatgatataaagtgcgtaagtcagagaagaaaagagaccccagaacagaccggcaggtgtcatggataactggtccaactgcccatgagtggcgatcagaaaggtccctccgatggctaatatgatagaaacaatctctcccagtgtcggtgctaccttatccttgatacagctataaatcaaaatcccgacagggcaaacatactgaagcaccgtcgcggtccctgcattggtctcctgaatagcagttagataggcaaattggttgaggaagagaccaattagagcaaaaataagaagagacagcaaactcttcttatccgttaaaaaggccagcattttatcctttgcagtaacataagccaagaacatgagaatcccaccagcgattaaaagacgcaagttggtcaaaaccagagccgaaattccgtgcgccatcaggtattggccactcgttcctgacaagccccaagcaataccagccacaactgttagtaaagtcccttttaaactatttgacatgtctctccttactcttctttacgaatcaagtccatcacttgattgcggtctaatatccactgggctcgttcatccttttcataggtacgattcgataggaaaatgaccgcttcttgcttctggcgattccacatgataaaggtacctgtatagcccgtatggtctagccaatctccttccaaattccatgccaaagaacgttccttatcatccaaaggtgaaaagttttgactcaaatttcttgcaaaatcatctgctaaatagtgttctaaaaagatttgtaaatcctttacagtcgaaaacaaaccagcactaccagcatgtctacccaagagacgagccttgggatcatgaacttttcctgcctccacacctctgactgttggaacagcacgctcaacaggaccaaactgggtttccatcattccccaaggtttccagacttgctcctgtaaaatctcatccaggtcttgattaaagattctttccaaaataaaacccaacagcaaaaaatggacatccgaataaagaaaggctggctgatttcgtctcctgagatgaaacatagcttcctttaattctaaggctgttaaaagatctctattgggaataaaaggatcaagagctgttgcgtgagtcaagagctggcgaatagtgatatctggataatcactttcaggtaaaaaatcggttactggtctgtcaatatctaattgaccgttttcccacaaaaaagtaaaaacggtgccaacgccaacaaccttgctgacactagctaggtcataaactagtcctgcctcagtctgcaagccatgctctgggtcactctggcctaaatagacctccgtccattgattgtccttaaaatacgcaaaagaggctccgggatagatccctgcctcgatttgttcttctatttttttaataatcttggtccacttcatacttcttcaaaccacaattcaacattatttctatctttaccaaggaagaatttttcagacttaggaataaaatattctgtagactcaaacctctggcacagactggctaaatctaattcattgaccaagaacttgagcatagacaagtcccaggtaaccgtactgtccacagtcagatcctgcccctgagctggaataaaatcaagggattctccaacttcagatggctccaagaaactatcaacatcagttgggagatgtaattccatagaaatctcaaatttacttaaagaaattgattcgagatctgtttgaaatctaggcttttcttctacttctactagactttctctatcatcttccgcatgaatcaaaaccaaatcatcttcgggtgaaaaaatctcaaaagcgtagccattttgacctttatataattgatgaatcgaatctgttttagctaataaggcctcgatttctaagggattttctaccttgacaatcaatctagctagtttttttcttccctctaccttacgagtgcgcatacttggagcttcttctaaaaccagcttttctaaacctgtttgatcacctagtgacagaaaggctgactcttctaataaggccttcatgccaagggttcctatataaaatgtttcatttaattttctattattaacttttaaagtaggaataatccgtacaatctgatttacattcataaactcctccaactcttttattttaaaggattttagaattttttacaagaaattatgctcagatttacctttttttcgtaaaatttcatctaaaaaaccgaggatttcctcggtttcaatttcttataggtaaaggaatttgaagatagctactgcggcaattgctgctgcgatcggtgctactactggtacccaagagtaccaccattttgaatcacctttgtgctcaccaagaactgattttggaaggaaagcatgaaggagacgtggtcccaagtcacgggctgggttcaaggcaggtcctgtaggtccaccaagtgatgttaccaaggccataactaggaaacctagtgccaagtgagcaattccaagaccagatgtcataaatggtgctacttgttctttagcttggtcaagtgctgctgttacttgttcttgaggaatggtttgaccttgagtagttgcttgtgcaacttgagcattaatagccgcttgtgcttttgatactagttcagcaccaaagaagtttttagtcattccaagagctgcaaagaaaagaacaaatgaaccaacaaactcatttacaaaaccattaacagttgctgcaaaatgtgattcttttgtaccattatccaaacttgaaatggttgagaaagtacccaagatgttgtttggattttcagttttcaagtagtatgggcggtgtgttgccacaaccaaggcttgaccaaagatagcacccaaaacttgtgcgatgatataaggtgcaacttgtgcccaagggaagagaccgctgatcgcaagtccaagagtgaaggctgggttaatgtggttacctgatacgttaccaaacatcaaggctgggatcataacccccataccataaccaacagcgataacgatccagccactttggtgacctttcgtacctttaagttcaacgttggcaactgcaccatttccaagaatgatcaaaatagcagtggccaaaaattcagtggcatatttaattgcccatgtgaaatccatttgatagattctccttaaaattttttagacaatccttattctatcaatttttatatcttttagcaacaggttttctaaaagaatatatgggaaagcggttttatttctcttattgaaacaaaaggattaaagaggtggatttccttaatccgagagttcttattcttgacgttgtccgaaatctgcaatcatctgctccatttcttgtcgactcggagttgtcagcatataaaggtaatctccttgaagttccgcaaaggccgctggcatgatttttttaaccttgaaatactggctgtatttggcaagcaagtcctcctcagaataaacatagtgagcatttgcacgacgggatgtagctaaacaatattgagcttcaaagtctgacgctgggaactcttctcctgcgacaatcgccgcatagcctcggtagagatccaaggaatgagcaaagttataaacatcaatggtaaaaccacctgcaggacggttattgtactcaatggcaatgtagtcgtccccttcacggaagaactcaatatggaagaaccgttctttcataccaaattccttgacaatggcctcaccatatttacgtaatttgggatccatatccttaagaacatagtaggaattgtccatcttgtaaatcatgagatcaagcggtgtataggcgtagtcaaaagtcgttgagaagacaatcttaccatccttgtctacgagcccgtcaaaggtacagatttcactagaagtaacaaatttttcaaagaaataaacggtcgaatggtcccattcttgcttaaagtgattgatatcatcttctgtctcgagcttaaaggttgcggctgctcccactccattatcaggtttggcaatcattggaagaccaatttctttcactgcttgatcaacatctgcttccgtctggataacagctccaggtaccacagggacacctgcttttttgaagagtttcttcatttcagacttaaatttcgtctttttgagatcctctggtttggcaccaaagacattgaattgttctctgagtgttgcatccagctcaagccagtattcattatgagactcgatacggtcaattggcccatgtttataaaagagaaaagcaactgcacgtttgacttcatctatattttcaagattatctacgcggaaatactcagtcaggctattgcgtaaaggttcatccaattgctcgtatggttcttgaccaattcccaatactgtgatgcctttattagctagttcaatggtaaactgttgaaagttttgcggatagtagggagaaataacaaggtaattcataggtaactccttttataaatagagatttccaaggaaataaggcatttgtttgcgccaccattcccagtcgtgggcgacatcgtgtccccattcagcaaaccaggctggaatttgtttctggtcaaaggcttctttaagcttgtagaaagatggtagaccgtcttgttcccaggctccaagacccgtacacagcacaatctctgcctgacggtaacggtcaataaaccagccgtcattctgattccagatataatctactggcgagttttgataaatagcatcgtcattgtagtaatcgccaacaaagaaacgtgcgtcgtaaacaccactaagagcaatcacctttgtaaaaacatctggatgttggagaaaaaagttgactgcatggtaggcgcccatcgagcaacctgtcgtcatcataccatcaaaccaacctgtcttatgcttgataaaaggaatagcctcctcaatcacatagcgttcataggcacggtgcatttccgcttggtcgtgaccatttttccaagtggccaaccagctctcactatctacactggatagggtaaagaactgaacacggccttcctcgataaaagaagcacaagcatcaatcatgccaaaatcatagtattcattgtgactaccacctgatgaagcaaagaccacaactggaatccctgcatgtccataacgattaaggtacatttcacggttaagattgccactccagtggctaaggttttcaatatgcattggctttctccttttctaacttaccatttctctgcaaaaaatctcagacagtctggtaaattctccgaccaagggatttcactatggatggcaccagattgaactttcaagacaagattatctaagtgtaccccacctgctatcaaatcatggtaataccgaagagacgaatcgatataggcttgtttgatattaccagccatcagggtcttgtccgtatcatctgcttcttcagttccaacatagataaagatacgctggtcaggcgatagtttctggcgctcgatgtagcgattaaaggcttcttgatggagccagttggcagatgaaaagacgcccaagcaaccaatttggtcttggtattccaaaccgataaactgggtaatattgcctcctagtgaagacccaatcatagccgtatgctggcagtcagctttagtacggtaggtctcatcgataaatggcttgaccacctccataacaaactcggcatactccacgcccttaccgccaaattgctgtcctgggataggagattcttggaacttccaagccgcatactcattcatccgccccataccatcattgtcaatggcgacgacaatcatgcgactgatatcaggattacgcttaatagctgggataatcttccatgaatgtccaatgaaagactccttgctataaaaaacattttgcccgtcatgaaagtaaacaacaggataggaacgatccgtgtctttctcataatctttaggcagaagaacacgtacacggcgttccttacctgtatatggaaccttgagtttgtgttctttcatttttaaataaaagtaggattgattcattgtcagaaaactctctatattcaaaattttatctcattataccataaaaatagaaaaaaagttagttttgcttccgtttttggaattaaaaactaactttttcatttaattttctaaattcttttggattttctgattagagcatattgtcaatcaagtcatccacttcatctttttcagcctgcggtgtaatctcagtaatcatgattccagccactgctcgctcaactaaaccttcaacatccatacgagcttcatactgctccgcattcttaatcttaggatttgttttcggacgatctggcgcaaaaatggtacaacagtcttcaaaaggctggatagaaatttcaaaggtgtcaatttcctgagcaatgtcaatgatttccaacttatccattgtcacaactggacggatgatgggagtgttggtaactgcattgatagcctgcatgctctccaaggtttggctggctacttgacctaggctttccccattgatgataactaaaccatttcgtacctcacgaatacgatctgtaatccgcatcataaaacgacgcgttagagtcatcaagtaagcttctggcgctttggccttgatttcctcttgaatctctgtgaaaggtacttcaataaactggatatttcccccaaacttggttaatttacgggtcaaatcttgggcttttttaagagcaccaggactcgtgtaaggtgggctggcaaaatgaacagcctcaatatccaccccacgcttaagtgcaagataacctgctacaggtgagtcgatccctcctgacaacatgagcatccctttacctgaagttccaactggcaaaccaccagccccacgaatggtttcataagaaagataggctgcttcttcacggatttccacctgaagattgatgtcaggacttttcatttgagcttgcacatttggaatggcttcgaaaacagctcctccaagtgtttgattgagttcacgactatccaactcaaagttgtggtcgctacgcttgccagaaattttaaaggtcatgccatccttgtagatgtcctgcataatctcttggacagcagacttcagaacttctacagatttttcgaccttataaacaggagaaaagttttgaatcccaaaaacttgtttgagtgattctgctactgctgtgtaatctgctccatttaggtaagcgtgggcacggtcacgatctgccgttaccttaacttggggatagatagacaaaacgtctgatatattattgcgaagtttattgatgaaacgcatacgatttttacccttggttgacaactctccgtagcgaatcataatttctgaatactgcataaatgctcctatcttacttttctagtttgattgtaaattaattttagcttggtcaaaaactgctcgacctgactcatatcattttcaaggtctagactaagacgcacagctgactgggccttatccttgtccactcccatggcaatcaaggtgccagcaggtttcccagccttggacgaacaagcagaggtcgttgagatgaaaatatcatagtcttcaaaggcgtgaacgatgacttcaccacgaacacccttgattccaaaagtcaggatatgaggggcaaagtcttcctcatctgaaaagacaaatatatctggataatctaaaagagcttggcgaatcactgccttcatctgcccagtcttgctagtaaagacatctagcttttccatggacaaacgcagagccttggctgtcgctgctatccctgccacattttcagttgtcgaacgataatcatgctcctgaccaccaccagtcaaaagaggcgtaatcttcttgccagacttgatatagacaaaaccaacaccacgaactccgtggaacttgtgaccagagaaagtcgcaaaatccactcgttctgtcagatacttttcagtcggaatcttggcaagtgcctgaaccgcatcaacgtggaaggaaatagttggcttgtctgccaatagttctgaaatagcttgaataggttgaatcgagccgatttcattgttcacagccatgacggaaacgagggtcgtatcaggtcttatcaaatctgataacgcttcaacatttacaaatcctttgttatcaactggagcaaaatctacttcaaatccttgacttttcaaccagagggctgactctttgactgccggatgttcaatggctgatacaatgatgtgttttccaaactgagccttttcaaaggtcacacccttgatgacccagttatctccttctgtcccaccagaagtaaagaagatttcatcgcttttcttaccgattaaatctgcaatctgttggcgagaagcatctaagattcgtgttgcctggtctcccaaacgatggagactagatggatttcctaaaatttttgaagcgacctgcatataagtttcaagggcttcaggatagggcttggtcgtcgccgaattatcaaagtaaatcatgttttctcacgctttctaaaatcactccttctattgtatcatgaaacggagtctgcgacaagaaagggcaattcctctttttttaagatttttttaaagaaatgcggtataataaattttaattaaaggagagaatatatgtctaattatcgtagaacttcaaaaccaaaaacagaacacatcaaaaaaggctttacggtctttcaaaaaactgttgccactatcggtagtatccttggcttaattactgcaagtatcactatcatgaacgccttggataataataaaaatactaaaaaagaacctacgacaagccagacgacaacaattgtcaaagaaattcaaaaggaatcccctcaggaaaacactagtcccaataaggaaaataacacttctcaagaaaaaacacagcaagaggaaacaccaaaatctagcgtcaaggaagagaaaaaagaagagcagaaagcagcaactcaggattcttctactcctactccaagtaaacctgctactgaaaatgaaaaacagtccaataccccaacttcggaaaataaaactaatcaataatcactaaaatagcctccttccaaacttggaaagaagctattttttttattgttgtaaaacttttcttggtttggtaccttcagctggaccaatgacacctgccatctcaagctcttccatgagacgggtcgcacggttaaatccaactgacaaacgacgctgaatcatagatgcgctggctttctgggtttcgattaccaaagccttggcttcttcaaagagcggatcaccaccagattcaccatctgaaaattctccgtcattttcagaaacctcacctggatcaaaactctcatcgtagtccgcatcagcctgagccttaatgaagtttacgatacgttcgacatcatcatccgagataaaggagccttggagacgaactggatgattttcatcaattggtttaaagagcatatctccacgtccaagcagtttctcagctccattttcatctaaaatagtacgggagtctgttcctgatgaaactgcgaaagcgacacgagatgggacattggccttgatcagaccagaaatgacgtcaacggatggacgctgggttgcaagaatcatgtggatacctgcagcacgcgccttctgtccgagacgaatgatagcatcttccacttccttgctggctaccatcataaggtcagccaactcatccacaattacaacaatgagtggtagcggaacctgcttgtactcagactgagcattaaactcttctaccttggcattaaaacctgcaatattccgaactcccaccttggcaaagagttcataacgattttccatttcatccacgaccttttgcaaagccttgctggccttacgtggattggtcacgactggaatcaagaggtggggaatatcattgtaaacagacaactcaaccatcttgggatcgaccatcataaatttaacttggtcaggtctcgccttcatgaggatgctagcgataatgccgttaacagctactgacttccctgaacccgttgaacctgcaactagcaagtggggcatcttggaaaggtcaaaagctcttgcggtgccattaactgcctttcctagaggaatttctaagagattttctgctttcgtttgagattgttcccatagttcgcggaaggataccgtcgcaatctcagagttaggaacctcaatcccgactaaggatttaccaggtattggagcctcaatccggacatccttggctgccaaggctagagcgaggtcatctgctagattggaaatgcggttaacccgtacaccgactgctggcttgacttcatacttggtcactgacggcccaatttcagcccgttcaaccgttaccttaataccaaaactagcaaaagtttcttctaggattttgatgttttcacgaacgattttcttctctttcgactggtcttttggtttatctggggcaaagagttgtaagcttggaagtttgtattcaagggcttccttggctgaaaaatcgacctgaacatcttcgtcatcagagttatctccctgttcagggaattcaagttcagcttgaggcaggatgatttctggttctacccactcttcttctggaaaaggtggaacgtcaggcacaacatctgctgtcagaatttcacctgtttccatatcaataggaggcaaatcgagtaaggctttttcagcctcttcttgttctaatctagcctcttcctcagccttttggcgagctttttcttcttgtttaacaaagcgttcctcttttcgacgctcatgcccttcccgccatttggcaaagcctttactgcaaaattcagcaatatcgtaaacagaccaaggactgactaggagggcacccactaaaatcaagatagaaccaataaagtaagtaccgatatttgagaagagaaaggctgttggcacatagagtccaacaccaatcaagcctccaccagcaaaactggtcgttcgaaaaccagttaaatccgtcacaacctgagccatggttccttttagaacggacttgtccaaaccatatttccaaaccaagtaagcctcgaaaatcaagagcaaaccagcaaatatggttaaaaagcctgataggagtccttcctgttttcgtatccacttgaaaaagaagaggtagagcaggatgccaaatattgccagataagctaggctacccaccagcaagcgaatgaaattgtaaagggttatacctgcagcccctaatttgaaggctgcgaaaatcaataaaagcgcgattcccaacgaaatcaacattcgttgaatcgcttcttttctttcgagttctgctttagacggtctccgtcttgttttacttgtattcttgtttgccattcttctattataccatatttcacaggcatttcggaaagagaaaaagactgcaccaaacggtccaatcttttcatttttctattttttatgcttgtggtttgcgtaggtaaccatagaccacaccacttacgattgctcctaccaagacagaaacgaggtaaagaagagcatttgaagtaagggcaataacgaagattcctccgtgtggcgccatgagtttgataccagtaagaccaacgagtccacctgctactgctgaaccaaggatgaagcttgggatagcacgagctgggtcagcggcaccaaatggaattgctccctcagtgataaatgacaagcccatgatgatgtttgtcaaaccagagttgcgttcttctttagtaaatttatctttgaaaagaagagttgcgacaaagattgcaagtggtggcaccattcctccagccataactgctgccatggctacagaaccacctgaagaaacagttgctgcaagcgtacctgtaccaaagacataagccgctttgttgactggtccccccatgtcaacagccatcattccaccaaggacgataccaagaaggacagctgaacctcctccaagaccgcctaggaagtcattcatagcagtattgattgctgccattgggatattcacagctagcatgacaaatccagtcaagattgttccaagaagtggcaagagaaggattgattttgcaccttcaagtgaacgaggaactttaacgtatttcttgatagcaagaactaaagcacctgcgataaatccaccaacaagggcacctaggaaaccagatgagacacctgcaagagttgaagttgcttcaccacctgcggcataaggaattttaccaaaggcaaaaccttctttggcaatagcaccagccacgaaacctgctaccaaacctggtttttcagcgatagagtatgcaacataacctgcaaagactgggagcatcaaaccaaaggcagctccaccaattttcataaacatagaagctagctcatggtaggaaccaagattaccaagattttcatttggaacacccaaagcaccgtcaatcaagaaggcaagggcaatcatgataccaccacctataacgaatggcaacatttgagatacaccactcatcaagtgtttgtagaaggcaccaccaaggctttgtttttcgttgcttgctgtcgaagcttttgctccattagcagcacggtagacttcagcatctcctgaaagagccaagttaatcaattcttctgttttacggatcccgtcagcaactggacgattgatcaatggtttgccatcgaaacgatccatctcaaccgccttgtctgcagcgatgataacagctttagccttgcggatgtcctcagcagttagttggtttccaacaccgctagcaccgttggtttcaaccttgattccaacacccatttcagcagccactttttgaagggcttcttgagccatgtaagtgtgagcaatacctgttgtacaagctgtaacagcaacgataaactcatcagagtcattagtaggtgcttgaacaggctcttcagttttttcggaagctttgtcaaaaagttcgataacttggtcagctgatgttacttgacgaagtttgtcagcaaaaccgtctttcatcaagtattgagacaattctgccaaggctgccaagtgagtatcattggcaccttctggagctgcaatcataaagaagaggtcagttgattgtccatccaagctctcgtagtcaacacccttgtttgacttggcaaagagaactgtcgcttctttgacagcagcatttttgctgtgaggcattgcgataccatcacccaaacctgtagaagtgagagcttcacgcgccaaaattccttctttaaaggtttcaaaatctgtcacataaccgtggtctgtcaaacttttaatcatctcgtcgatgacagctgttttttcagttgcttgcaaatccagcaacataacatcttttctcaataggtcttgaattttcatcgtttttctacctcaactttttcatatgtttctttaataaattctgctgttgccaagtcatccgagaaggtagttgccgttccacaagcaactccccatttgaaggcttctactgcgtcttttgatttgacaaattcacctgtgaatccggcaaccatagaatcaccagcaccaactgaatttttgactgttcccttgataggttttgcgaagtaagctccctcagatgtgacaagaagggcaccgtcgccagccatggagataatgacgttttgagctcctttggccagtaactgacgagcatagttctcgatttcatctaaactttcgagtttcactccaaagatagctccaagctcgtgattatttggtttgaccaaaagtggctgatagtccaaactatcaatcaaggtctgtccttcaaagtcacaaacgacttgcgcaccagtcttgcgtgtcaaggcaatcaaatccttgtagataacattgcctaggtttttagcactcgaacccgcaaagacaaccgtatcttctgctgtcagactagataaaatagctttcaattcttctagctgagctggttcgacatttggaccggttccgttgatttctgtttcttggtctgctttgattttaacattgatacgagtatcttctgccacttggacaaaacatgtctcgatttcttcctctgcaagggtatctgtgataaatttaccagtaaagcctccgataaatcccgtcgctgtatttggtatatccaaacgtttcaagacacggctgacattgattcctttcccaccagcaaacttatcatcactgtccatacgattgacactaccgacttggacttggtccaaacgaacgatatagtcaatggatggattgagtgtgactgtataaatcatacttctattacctccgttttctccttaatagcctgcaagagctcatgcccttgacttgtgataacaatagctcgtttgagtggtgctaccttggcaaagcaagtttgtccaatttttgacgaatccaccaagacataggtctgtttggcattttctaaaatagcacgcttaacagctccctcctccatatcaggagtcgtataatagccatcgtccacaccattcatcccgataaaggcacggtcaaagtgcaattggttaatctggttaagagcaacgcccccgatgctagcatctgttgccatcttgacacttcctccaaccatgacagttggaatctgcttttcaaccaactgtgcggcatggtgaatcgaatttgtcacaacagtaatattcttattgaccaattcatggatcaaaaaagcagttgttgttccagcatcgataaagatgacatcttgttccttaatgagagaggctgctttctgagccagcaacttcttttcttgaaggtttttgacagatttttcttgaatggtttcttcttcctgcaaggaatggggcaattctgctccaccatgcacgcgacgaagcttgttttccgcttccaactcatccaagtctcttcgaaccgttgattctgaggtctctagcaaactaactaatttttctagagaaactacatgatgttgatttaactcctctaaaatcagttgtttccgctctgtttttaacactgaatcacctcctgttatcgtttacactattcattctatcacactttctttcaaagtcaagcattttttgtcattttctttcaaaatctatcatttttcttatttctagaatttttattgcaagataggggcctttatggtagactatttgagtaagtattggaagattactcaagaggcttaagaggccgtgttggaaacgcggtaggcgtgtaacagcgtgcgtgggttcgaatcccatgtcttccgtttattttaaaaaagatacccaagaaatctgtactgaccccaaaaagttagacaattaatttaagcaaaggatttagttctgtattgtacagggctaagtccttttagttttaccttaattcgtttgttgttgtagtaatcaatatagtctacaatagcttgttccaagtgttcaagtgactgaaacgtattctcataaccataaaacatttcagacttaagaatgccaaagaaagattccatcataccgttatctggactatttcccttacgtgacatagatggttggattcccttattctttaaaaaatgatgatagaaatcgtgttggtattgccatccttggtcactatggagaattgtattttcgtaatggttctctgtaaaggcttgttctagcatagctttcatttgtactaagttcggcgaagtagaaagattgtaggagataatttctctgttaaagccatctaaaactggtgataaataaagcttttggctgcttgctggaatggcaaattctgtcacatctgtgtagcacttttgcattggtttggttgcttcaaattgacgttgaataagattatctgctttcttgccaacctctccttggtatgaagaatacttccgtttacggcgaattcgagccgttaaaccaagtactttcatcagacgctgcaccttcttatggttcactacgaagccacgatttcgtaattctagagtcatgcgacgatagccgtaatttcctttatgctcagtataaattgactgaatttcagctttaatatcataatctttatcgctttgatccagctgttttaagtggtaataataagttgaacgggcaagtttaataatctttagaaggatatctaaagaaaactctgttaccagtccttgaacaatttccgtttttcttcttgctccttttcgtctctcaatcggagttctctcaacttttttagaatggcattctccgctctcaagtactcattttctgcttgaagacgttctaattctgtcatatcttcaaatctcttctttggcttacgtcccattttaggtggtctccctcttgttttctcaacaatagtatacccgtttttcttatattgtgccagccaattcgaaagtaatccactacttagaagagcataatccagagacgccctaatttgtgaatgcccctcaagaagaactttatcaatgatctcttgttttagttcaggagaatagtaacaattctttccttttttgacgaactctattccgtaacgatcaatcaatttaatcatgtacctaagattagaattgtttatcccaaatttatttgaaagcttctctaagctatatccttgttttctaagttcatagatctgaactttatcatcataactcaatttcataataaaacaccccaaaagttagattttttctgtctaacttttggggtgcagtacaatcttgggtatcttttttcttatatgcttgttttataactcgggtgaatttcttagaaaatatcaaataacaatttcacattgagaattgttaagataatggaaacgatatagccaaggatggtattccatttggcattggtaaattctcccatcagtgatttcttagaagttagataaatcagtgggaagattgaaaatggaagagcaatcgaaagaaagacttgtgaataaaccaataactgatccaatgttttttcctgatgaccaaacagaaccgctacaatcatgacaggcaacaaggcaaagagacgagttgccaaacgaatgaaccattgaggtaatctcatatgcaagaaaccttccataacgatttgtccagtcaaggtacccgtaattgtcgaattttgaccactggctaataaagccaaggcaaacaaggttgataaggtcgagctagctatagctcctgcaatagtagaatcctgcaaggcattatacatttgagagaaggcagaaatctcagatgcatggccgaaaaagagagccgccccgagaattaatagaagggagttaaccacaaaggccaaggataattggagatttgaatcccaggtcataaagcgcacggcttttcgaacatcattcttgtccttgtgattgattttccgagtttgagacaaggaagaatgcaaatagaggttatggggcataaccgttgctcccacgatccctagtgccaaggttaattgactttcatgccctggcaagggactttcaaataaggttgcattcggtagataaccctcaacgattccttggaagcttggatgtgacaaagctaccagataggtaaaaattgctagaatggttaaaatcagtgttgtcacaatagcttcaatcttcttaaagccaaatttcatcagaagcaataagagaaaaacatccaacacggtcaagagaattgctatcataatcggaatcttaaagagaagattgagagcaatcgctgaacctagaacttctgccagatctgtcgccatcaaggctaattctaaaatcacccatagactataacgaagccatttaggtgaatgatgagccgttgcttgagccaggtccatctgggttacaataccaagctttcctgccatctgctgaagttgcatggcaatgagagatgaaatcaagataacaaacaagagactatacttataggaagcaccaccgactacactggtaatccagtttcctggatccatataaccaactgcgacaagagcacccggacctaaaaaggcatttaaattttgccagaaatgattgttatttggagtatcgatagattgattaatctcagagagtgacacttttttatgagaagacatagatacttacctctttctaaacctactttttcattattttctattagagaaaaataagattgactttaaactattaaaacaatgaaaactatatgaaaaacatttagttttttcattatttttcttaaggcaccttaatatttttcttaaggcaccttaatatttttcttaaggcaccttaattataacacaaaaaatgaaaactatatgaaaaacatttagttttttcattatttttcttaaggcaccttaattataacagaaaatatgataaaaacttaagaaaattcaggacttgatttaatatttaggatacaacaaaatgttgtattctttttttgcaaaagaataccaaagaataaaataaaaaacgttgtaaaaacaacgttttagaaagatttacaaaacaatgtaaattatcaatggagccggtgggagtcgaacccacgtccaaacatctgctaacatatttgtctacaaccataggttatgtattcgtttaacagtccctcgacacataactcaagcctagaaaccgcgagtctatcaatctcttatcaagccgctagacaaggcttgatcgtatctcgctaataataagacctgtcattgaacacgagcaatccaaatcgggtcacgcctgctggtttttaggcagctagagcgtaagaagtgttattttttgcagttatatttaactgagcgtttacgtcgccacacgagtcgcaaaatatgcctcataatgcctgtcgaatccgtaacgaccccaaaagacaataaaaccattataccttatctaactcaaaaatgcaaaaaggaaagcaattaactacaaaagatagtctttcaaagattttgtcaaaacctgataaccgggaacactaaggtgcaacccatcagttgtataatcttttttgagttggcctgcctggtctgtcaaactatcaaaaactggcgcaaattctacctgcatataggcagaggaaagttctttataggcttgattccatttctgaattttttcattcgtgcggatatagactgtctgcttgtactcctcgccctcattgactggcaaaatggaaagcaattttatctctgtcagtggataatcgcgagcaatggattgtatgatagattcgagattattgagagcctcattcacaggcacatcttttccgatatcgttcgtcccaattaaaaggacaattttatctaccgccccaccgtacagatgcgcatccagattctctaataacagccctgtctgataacctcgaatgcctcgattgacaatcgtctttgcagtcccaaatagttcctgcagaggataatattcgacaatggaatccccaataaaaagaatgtctggctctacaacagaaacctgatttaagtgacgatacttggtttggattttttcttgttcctttaggagccaattttctaataactgtactgccacttcattctcctttttctaaccagttctccaagacttgataaactcctccttggctattggctggcgctagagcagtcgccacagctttggctttatcatcagcattttccatcgcataggcaattccagccatttcaagcatttcaacatcattttcactgtcaccaaaagccatgatttgttgggaggtcaagtcccagcgcttgagtaattcttccaagccccatgctttatgaattccagcttgaaggatatcaatgcaaccatagccactcgatacagcacgaacacggccatcaaagaggtcattgatttcttccaagaccgaactcaaacgttcctcaccaacaaccatactcatcttgagcacaccaccaaagaggtcagaggttaattcgtccacaaattgcatccgttggtagaatttttcaatcatttctggagtcataaaactttcaaggtctgtaaaaatcgtaccttctttgacgaaaccacccttcatagacgttacaacaaactgatcctgacacgctcgacccttaaaatgagccaaagccttatcgacaatggcatcatcccaagtctgagcctgaatcagttcattgttttcaaaaatacgagcaccgtttgcaacaaccagaaccacccgatcgaccaagtgctccagtagttgcctcatgcggtgaatttcattcccagtcgcaatgacaaaacgaataccccttttatccaactgatctaaaatcttttccaaacgtgggagatcaagctggcctctagcatccagcaaggtcccatccatatctgttgcaattaccttaatcgtcatttactttcctctggattcaagctagtcccacttcaatcccacatgttcgttcatttctttgtaggctgtatcaattcgttccttagtcgcttcatctaactggtcacgatgactaccaccctcgataaaatcttctaagatataagtttggtataggaatagtggataaccttctggagaataggttccttttggtgtacggtttacccaagaaggatgcgcttttgcagtttcgattgtcgtcttaccggcttttttcttaatagtcacatccatgagcacgccgcgctctgtccacttagcattctcttcatcttgcatggtttcaattcgttgattggaaatgaagttccccattgaatagataatgagtttcttgtccccatctttttcaaccgtttcagatggttcaactacgtgagggtgccctccaaagataatatccgctccccaatcgatcatcttgtgataaagagccttttgttcttcagttggttccaagcgatactccacacccatctgaggcatgataatggtgatatctgcttccttctctgctcgttcaatttcagccttcatcttgtcttcatttaggtctgaaagatagcggttatagtcttcttgagaaatactttgctcaattccattaaaaccataagaataggctaaaagtgcaaccttgatgccgttcacttccttgataaccagtggagcttgatcacgtgactcatgcgtatacactccaataggtgtcattcctgccttctcaatagcatctgctgttgaaaccacaccttctatttgtgaatctaggatatggttatgcgccaagtctagcacttgataaccggcatccttgatggcatccataacttcaccaggtgcattaaataggggataacctgccaaatagtggtccttgttcacagtaccttcaaaatcacctataattaggtctgcttgtttgagccatggtttcacataatcaaaattctcatgaaaatcataggtcccatcttcttttaaagccgaacgataaataggaatatgataaaggaggtccccattggccataattctagcagttttttcctcttcctgatctttagtattttgattggtcttatttgcttcttgagaaatggcatcctttttttgactggttaaggggattccttggaagctttcaaacaacaagaccaagcccattgataaagcaactgctagcaagagtatcgccacaaatcccttattgctccacttgcgataactcctaaaaaagtttacaaagcctctcacaaaatgaaaaactggtccacgtttatgtctatcttgtcttctttgcatcttcattctccctactttctaatgcaagccttttctttttattatatcacagataagtatttctttcacaattgaattgaacttcctatctattttctataaatcctaaaggctgtaatactttcaatccttgtcattttgtgatatcatgtagaggtaatgaaaggagagaaaatgtctgcaatagaacgtattacaaaagctgctcacttaattgatatgaaagatattatccgcgagggaaatccaactctacgcgcggttgctgaggaagtcactttccccttgtctgaccaggaaatcattctcggtgaaaagatgatgcaattcctcaaacattcccaagatcctgtcatggctgaaaagatggggctccgaggtggtgttggacttgctgctcctcaattagatatctcaaaacgtattatcgctgttttggtaccaaacattgttgaagaaggtgaaactccgcaggaagcctacgacttacaagccattatgtacaatccaaaaatcgtctctcactctgttcaagacgctgctcttggcgaaggagaaggttgcctctctgttgaccgcaatgtgcctggctatgttgttcgccatgctcgcgttactgttgactactttgacaaggacggcgaaaaacaccgtatcaagctcaaaggctacaactccatcgttgttcagcatgaaattgaccacatcaacggaatcatgttttacgatcgtatcaatgaaaaagacccatttgaagttaaagatggtctactgattcttgaataaataaaatcccgttgcaagacggggttttgtgttataatagaggcatgaaaacaaatgatattgtctatggcgtccacgccgttaccgaagccctccttgcaaacacagggaacaaactttacctccaagaagatctccgaggtaagaatgttgagaaagtcaaggaactggctacagaaaaaaaagtatccatttcttggacttcaaaaaaatccctctctgagatgactgaaggtgctgtccaccaaggtttcgttctacgagtatccgaatttgcctatagcgaactggaccaaatccttgccaaaacacgccaagaagaaaatccacttctattgattctggatgggttaactgaccctcataatctaggttccatcttgagaacagctgatgcgaccaacgtttcaggtgtcatcattcccaagcaccgtgctgtcggagttactcctgtcgttgccaaaacggccacaggtgctattgaacacgttccaattgcccgcgtaaccaatctgagccaaactctagacaaactcaagggtgaaggcttctggacctttggaacagatatgaacggtactccttgccataagtggaatacaaaaggaaaaatcgccctcatcatcggaaatgaaggaaaaggcatctctaccaacatcaaaaaacaggtcgatgaaatgattactattcccatgaatggacatgttcaaagccttaatgccagtgttgctgcagccattctcatgtacgaagttttccgaaatagactataaaaaaagtttccagtcatctgattggaaacttttttatgattaactatgttctgtaataaacttgtaagcttcttgacctgcgatagcgccatctccaactgctgttgtcacttggcgaaggtctttcaagcgaacatctccaactgcgaagataccatcaactgcagttttcatgtggttgtctgtcacaatccagccagcctgatcttgaatattcaattctttaacaaaatcgctaagagggtctaatccaacatagataaagacgccaccgaaggcttgctctgtcacttgacctgttttcacattttcaaagacgacagattctactcggttttctcccttgatttccttcactacagaatcccagataaagctgattttctcattcgcaaaggcgcggtcttgtaaaaccttttgggcacgaagttggtcacgacggtgaacaatggtaacagtcttagcaaaacgagtcaagaagagggcttcttcgacagctgaatctccgccaccaactaccaacaaatcttggtcacggaagaaagcaccatcacacacggcacagtaagaaacaccacgactgttcagttcttcttctccaggtactcccaaaggacggtgtttagagccagtcgctacgataacggtacgagtttcatatgtttggtcatcagtcatcactttcttaaaatcaccatggtcttcgacattttcaacataaccataaatgtgctcaacaccaagattttcaagcggttcaaacatcttttctgccaattctggcccactaatattagcgtatccagggtaattttcaatatcagatgtattattcatctgaccacctggcagaccaccttcaatcaaggctactttcagattgcttcgagcagcatacaaggctgcagtcatacctgcaggtccagcaccgataataatagtatcgtacatatagtttccttctttcttgttgtaactatctttattctaactctttcttgtcaatcacgcaaggattatgccttgaaaacaagaattaaactcataaccgcaaaggataatactggaacaaccaaaacaccaatcataatcatatcatagagatgggcttggcgagccttggctgtcttatcaactcccgacatggctctcagtccaatccaaatccctaaaaaaatcaggacgaggatggtggtcaagatcaaactctcgaaatataaagaaaatagttgcagtagcatgatttctctcatttctatcttttttaaagagtaaactcagctagtccagctaactgagtttttctttatctattatatcaaatataagtccgtttgtaactagcgaagaattcttttgttcgctcttctttaggatggtggataatctcatccggtgttccagactcaatgattttccccttatctaggaagagaatcttatccgcaacttgagctacaaaggacatgtcatgactaaccaaaatcatggtttgacctgacttagcagcatctgcaatagacttttctacttcgccgaccaattctggatcaagggctgaagttggttcgtctaagagcaagacatctggtttcatcgcaagtgcacgcgctagggcaacccgttgcttctgtccacctgataaatggcgaggataatggttttcacggtctgaaagcccaaccttagccaactcttccttggcaatcttggttgcttcttggtcggataatttcttgacaacaaccaagccttctttcacattatcaagtgctgttcggcgttcaaacaaattaaactgttggaaaaccatagacaacttacggcgtagggcaaggatttcttcttgagtgattttagaaaaatcaactgagaaatcatcaatctgaatagagccactgtcaggtgtttcaagataattgagactacgaaggaaggttgattttccagctcctgaagaaccaatcaaggctacaacttcccctttttgaatatccaagttcagatgatccaagacagtctgtcctgaaaaggatttgcttaaattcgaaatcttaatcattaacgaaggtctcctttcacatctgtttgcactgtatcgggtgcagaaatagccatttttctctcgatgaaacgaccaaggctttcaattccgatattgactacccaataaacaagggcaacggagataaagcgttcaaagtagcggtaatcagctccacccaaaatctgagcttgggcaaagacttccacaacacccgcactaaaggctagagaagttcctttggtcaagccgattagggaattgattaaggttggagtcgccacaacggccgcatttggaataatcacgcgacgataaacttgcgctcgggtcatccccagactgcgtgccgcctcaatctcaccaggattgactgagagaatggctgcacgaatggtttcactagcataagctgcttcattaaaggcaaaggcgacaattgcaaaagcagcggctggaatcgcattgatattgaaaccagttccccattgctgattgagagctttcaaagccaaaggaattccgtagtaggtcaacatgagttgcaccaaaatcggtgtcccttttaagaagctaacaaagaaggcctgcaaggggtataaaattttgacacgattgatcttcacaatggcaaaaagaagcgccaaaaccaagccaaaaagagcaccaccaatggtcaacataatcgttattggaagttgttggacaattctcgggattccatcaaagaccgaacgcaagctaaaaagcttgccatccggaatcaattgcatcaagttttggtaccaatctgatgctaaaatcgttgtaacattcataaaaacatcctctcctgataatgattcattctaccatacttttgccgtcaatgaaattatttgctacggtcaggtacagactttgtctacctactagtttatcatactttgaaacagggaggttatatattttatctatcaaagagatagataaaaactatttcaatcccaattcttcataagcttttcgataaccgatttgcttaacagttccattttctactaaaatggggcgttttaacaacataccgtcgcttgctagcaactcagctgcttcttggtttgacagacttcctaccttatctttcagccccaattcacggtatttgatcccactggtgttgaaaaattgcttcaactcaaaacccgaggtttctagccagtttaaaatgacttcttggctaggtgtttcttcaacgatatggatggctttatagtccacaccgagttggtttaattcttgttttgcttttttacaagttgaacattttggatattcgataaattctaacatgtctttcactttctattttatatctttaaaatctgcgccttcatgctccaagagccaagctttcttttccactcctgcagcataacctgtcagacgcttgccagctcccagcacccgatgacaaggtactaggatagaccacggattgcgtcctatcgctccaccaattgcttgagcagaagccacttgtagctcttgggctatttgtccataggtcactgtctgaccataaggaattccctgtagataggaccaaactcgcttttcaaaatccgttccgattggagccaagggcaagtcggataaatcctgagacttgcctttaaagtaatcatctaagcaagcaataactggatctaaaattggatgactaacaactgcttctatcgtctcatctcctagtcctctctcaaaatgcttctgctcctgcacccaaatgccatacagatattgctcgtcggcaaccaaagacaaggttcctattggcgaaaagtagagcatttttacgtacatcttttgcattatttctttaatttttgataggccaagcgttcgccatcaacaggcactttaccaacctgtttaaaaccaagtttttcaaaaatatgctgcatgaccttgtttgcaacatgcgtatctgagcgaaaatctagatagtcaaaaccttcaatcaagccctctaagaaggtttgagcaacgccctgtccctgtacatctgctgccacagcaatacggtgaaagactaggtactctgactccccagcttgccagtttccttcataaatggcttcataggctgcctctggactcttggtcacagctgcataagctagtaattctccctcttccaaggctacataggcttgacctgagataatatcctcaataataatatcagcatttggataaccattttgccactggtcactaccagcatctgctaaacattttttagcatcctccatcacctgcatgatggtatctacttcatttggaaaagctaaacgaatttccatcttttctcctcatttctgactagtttctcccatcatagcataatttaagtctttctacaagcagttaaaacttgactttctatttctattattttataatctagttattaaaactagataaaaaggagttgaaaatgaaaactaccttttcctacccaaaatgggcagaaatcccaaatattgacctctatctggaccaggttttgctctatgtcaatcaggtctgctcccctatctctcctgataaagacaagggcctgacagcatccatggtcaacaattatgtgaaacatggttacctaacaaagcctgacaagaaaaaataccaacgccaacagattgcccgtctgattgctatcacaaccctcaagtcggtattctctattcaagaaatagctcagacacttaatactctccaaactcaagcaagttcagaccaactctacgatgcttttgtggactacatgaaccaaggaattgacccagctaaccccattatccaaaccagctgccaaaccgttaaactctatcatcaaaccctagccttaatcgatcatactcaagaggaggtaatccaatgaacactagtcttaaactcagcaaacaactcagtttcggagaagagattgctaatagtgtgacccatgccgtaggtgcagtcatcatgctcatcttactgcctatttcatcaacctatagttatgagacacacggatttttatcctctatcggcgtttccattttcgttattagtctctttctcatgttcctatcatccaccatttatcactctatggcctatggttcgacccacaaatatgtcttgcgaatcattgaccattctatgatttatgttgctattgctggctcttatacacctgtcgtactgactttgatgaataactggtttggctatctgattattgctatccagtggggaacgaccatctttggtattctctataaaatctttgctaaaaaagtcaatgagaaatttagccttgcactttacctgattatgggctggttggttctagctatcattcctgccattatcagtcaaacgacaccaattttctggagtctcatggtaactggcggactatgttatacagttggagctggattttacgccaagaagaaaccttatttccacatgatttggcatctttttatcctagttgcgtctgccctccaatacattgccattgtttattacatgtaaaaaagttgagaaattcaatctcaacttttttctttacacatattgataaagtactggtgcaagcgcacatcatcagtcaattctggatgaaaagaagttacaaacatatttttttcttgggctgcaacgatttgattatcaactgttgctagaatttctacaccctctccaacactagtgataattggaccacgaataaaggtcattggaatctgaccgactcccttacattctgcttccgtatagaaacttcctagttggcgcccataggcattgcgctcgaccaccatatccatagttcctagatgactctcttcctgagaagtaatttctttagccagcaaaatcaagcctgcacaggttccaaaggctggtaaaccagatagaatggcttctcgaatgggaatcagcatgtcctgctcacgtaagagcttgcccatggttgtagattccccaccaggtaatatcaaacccgacaaatcactctgatgtttctgaaaatcttctaaatttctgatttcaacactctcgacacctaatcgatctagcacttttgcatgttctgcaaaggccccttgcaaggccaatattccgattttcatctattttcctcgctctgccatgagaatttgaatttcattttcattaataccaaccatggcttcgcctagatcttcagagatttgagctaggatttgaggattacggaagttagttaccgctttgacaatggcactcgctcgtttaacaggatctcctgacttgaaaatacctgaaccgacaaagacaccctctgcccctaattgcatcatcaacgcagcatctgctggcgttgcaacgcctccagccgcaaagtttacaactggcaattttccatgttcatggacgtattgaaccaattctacaggtacctgcaagtccttagcagcaacataaagttcgtcctctcgtaagttttgaatacggcgaatttcctgattcatcatacgcatatgacgaacagcttggacgatatcccccgtacccggttctcctttggtacgaatcatagaagcaccttcagcgatacgacgcaaggcttcccccaaatccttagccccacagacaaaaggaacttggaattcttttttgtccacatggaaacggtcgtctgctggagataaaacttcactctcatcgatatagtcaatctcaatagcctctaaaatctgagcttcaacaaaatgcccgattctgaccttggccattactggaatactaaccgcttcttggatttccttaatcatctttggatcactcatacgggaaacaccaccagctgcacggatatcagctggaatccgctccaaggccataacagcagccgcaccagcagcttctgcaatgcgggcctgttcaggattctgaacgtccatgataaccccacctttgagcatctgtgccaagtttttatttagttcataacgattttcagtcatttattttatcctcattatttatattggtagctaccatttcattttaagttagattaaaatgaagtacaagataaaaaaaacgtaattgtgtgggtacagattggctaaaaaaactatctgaccttagcttaaggccagatagttcatcaaattttatttttcagctgtaagggcagccattgtgatgtagttatatggtttgttgaagtgtggcaagaagaataggtctgtcaatgccaatttatcaattgtcacatgttcttggatagcaagtgagaacatgtggattcccatgctgattgcagaatcgcgtgaaaccatttgtgcaccaagaatttcacggctatctttgtcaaagacaatcttgatggctacttcatggttatcatgtttcatgaattctggtttttgaagatcgttaaagcctgtttcagttgcattgtaaccagcagctttagctttttcaagagtcaaaccagttgaaaccatgtgaagaccgtagattgagataccgtttgatccttgaacaccgattccttccaattcatgtccacatgcgttatatgcaccaacgataccagtacgaacagcgtttgaagcaagcgcaatgtagctagtgtctttacgagcgttgtcataaacagtcgcacagtcacctactgcgtaaacgcctgggatagatgtttcttgttttttgtctacaaggaaggcaccgttacggaatagttcaatttttccatcagcaagggctgtgtttggacggaaaccaactgcaaggataaccatatccacatcaaaagtttctttatcagtaatcaagcgttcaactttaccgtcaccctcgattgctttaacagtttgaccaagcgccaagcggatgttgtggtcttccaagttcttcgccatcatttgtgtgaagtctttgtcatagtaaccgttcaaaacagtatcaacgatatcaacaaggacaacttcttttccaagacgttcaaaggcttcagcaagttcaacaccgatataaccaccaccaacaacggcgattcggtcaaggtgttgactcttatcagacaatttgtgaatcacttcttcagcgttttggtacaatttcacaaattgtacgttttcaagagttgctttaaattcacggtttcctttaacaatttcaacaccttcgattggtggcaagattggtgtagaacctgtagcgaaaatcaatttttcatatgattctttgtgctcttttccttcaacttccgctgtaactactttgttatcatagtctattgaaagaactggtgaattcatgtataccttagcacctttagcttccaatttttctttatcagaatagaacaagccttcagcaccgtcaatttgttcaccaatccagagggccattccacatcctaggaaagaaatgttagagttttggtcaaatacaacgatttcgttctcatttccaaagttatccaacatagtgttaatacatgctgtaccagcgtggttagcaccaactacaacgattttactcatagaaaaattcctaccttcaattttaaatttacccctctagtataacatttactgttagcgtttacaagagttttgctaattttcccgttttttttgtaaaaaatgtaaataatctgtattttatcagtctttcttacaattactctttattttctgagcatatttcttgacaagtttacaaattttatttgtgaaaacgctgactttatggtatgctagtatcatgaaaagaaaatgtaaggggttaaacttaatataaatttactatatttcagtcttcttttcataaaagaaaggagttggtagcttgcctcttagttcacattccgaacggctaatggggactactatcactatttcattagtagatgagcgagccgatagcttgatccagaaatcctttgatttactcagagagcttgaataccgcttcaatgccaatagtcaagaatctgagttgatggaaatcaattatcaagctggaatagctccagtcaaagttcatcctgatttgtttgaattgatttcacttggattagagcatagcctagcgccctctagtcatctcaacatcagcattggtcccttgattcaaacctggcgtatcggtttttcagatgccaaggtcgcccagcctcaagaaattgaatcggtgctacctttaatcaatcctcattatatcgagttagattcgtccacttccactgtgtttttaaaacaaaaaggaatgaagatcgatcttggttgtttagccaagggttatagtgcggataaagttgcccaatttctgagagaagagggagtaacatctgccttaatcaatctgggagggaatatcctgaccattggaaaaaatcaggcaagaggggatcacccttggcaaattgggattcaagacccagccaatcctaggggaaatcacttaatgaccatccctgttgtcaataaatctgtcgtgacttcaggcatttatgaacgtcacctgactgtcgatggaaaagattaccatcatatttttgacagccaaacaggatatcctgttgaaacggaactagctagtctaacaatcatctctgataaatcagttgatggtgaaatctggacaactcgtctatttggagaaagacctgcttctatcctctggcaagtcgaaagtttggagggcatcgaagctatcctcatcgataaggaaggtcacctaagctgttcttcaggaattccaactctatagaaatagatatttcaatggagttttaaaatcgtattatgtaaaaagagaaaggaaatctcatgttaaaacttattgctattgttggaacaaattcaaaacgttctacaaaccgccaattgcttcaatacatgcaaaaacattttgctgaaaaagctgaaattgaacttgttgaaattaaagacattcctgtcttcaataaaccagccgacaagcaagtacctgttgaaattttagaaattgctgctaaaattgaagaggcagatggcgttattatcggtactcctgagtacgaccactctatcccagctgttttgatgagcgctcttgcttggttgtcttatggtatttacccactcttgaacaaaccaatcatgattacaggtgcttcttacggtacgcttggttcatcacgtgctcaaatgcaacttcgccaaatcttaaacgcaccagaaatcaaagcaagtgtccttcctgatgaattcttgctttcacattctcttcaagcctttaatccaagtggagatctagtagatcttgatgttattaaaaaactggatgctacttttgacgacttccgtatctttgtaaaaattacagaaaaattgcgcaacgcacaagccttacttcgcaaagatgctgaagaatttgactgggaaaatttgtaagataggagaccaaaaagaatgaaatttgttggacttgtaggatcaaactacgatcaatcatataaccgtaaactcttggaattcatccgtcgtcacttcaaactcaaatttgaattagaagttctcgaaattgacgaagttccaatgtttaaccaagacgaaaaatgggatgaaagtttccaattgcgtctcttgtataacagaattactcgtgctgatggtgtcattatcgctactcctgagcacaaccacacaatctcagcttctcttaaatctgttcttgaatggctttcatacgaagttcatccatttgaaaacaaaccagtcatgattgtgggagcttcttactacgaccaaggtacttctcgtgcccaagttcaccttcgtaagattcttgacgctccaggtgtcaatgcctacacacttccaggaaatgaattccttcttggtaaagccaaagaagcatttgacgcagagggcaatatcacaaatgaaggaactattaatttccttgaaacatgcttggacaactttgtaaaatatgtgggagtcgtttcaaaattgaaaaaaccaaaaccaattgcaccagaagatttatattgtacaaattcaattgcaactaccattcaaggtgttgatccagacgatcctgaatgggtagaaaaagcagctgaacttgttggagctgtttctggagatacttacgttaaattagaccatggtatcttgacagttaaccaaattgacatgttcttgaaagcaatgccatttgagttgacatttgcagatgataataaccagttcttgtactttaataacgcacaccaagatccaaatacaatgtttggtaaacgtgtacgtgctcaatcaggaaaccgtttaggaactgtacacggttcattgccagattctcgaatgaaaaacgttgaatgggttgttggcgtactgcgtaacggggatcaagaatatgtccgtacaattgtgccaggaacaccagaaggcgttattaatacccataattaccaagcaatgtactatccagatggttcatatgctggaatcaatgaaatcatctttaatttccaaccatggcttgactggtacctcaatacaactggtcaacgtctagttggtggaaatgctgcagctcctgccggaggccacggtggcgcagatgccacatctggagcttctgatgcaggtgatgctggaggtcacggtggtggcgcagacgctacatctggcgcaagtaactaataatagttctgggaaccatattggttccttttttagcgaaaaaagactagcagacaaaaactgctagtcttttggtattatttcatctatctttgttaaaagaaagaatatttatactcaatgaaaatcaaagagcaaactaggaagctagccgcaggctgtacttgagtacggcaaggtgaagctgacgtggtttgaagagattttcgaagagtattattatgaatttggatcatcgagactacgaccatgtaaccctttttcacgttgaacttgacgtagtttctctggtgtaacatcgtttccttcttcgtccacaattttgatcccttcgatgtggtgacgaacagtgcgacggtacccttcgatgtactcctcacgtagtttggcttgttcaactttttcttctggtgtcaagccttctgtttttttctttttggcaagctcgttaatacgatcaatttttttaggatccatgtttctctcctttgtgataagataaagtccgtttatcaaattttatttagtgttaatttggttaaaacgagcaagcttagctgctttttgagttaaatgagacaagattgccaaacgattttgacggacagcctgatcttcggccataaccatagtattttcaaagaaagaatcaataactgggctaagagcaaaaagttgtttcaattgctgactggcagtacctgataaaacgagtgattctactgcttctgccaaggctttttcttggtcattttcaaagagtgctgaatcaactgcaacaactccttctgccttatcagccaagttaaaggcacgagaaagtgattcaacagatggtttgaaatcttcttccttacttgcttctacaagagcacttgctgcttccaacatatccgccacaacaaagtttgaacctgcaagaacggcttcctttatatcttttggagtagaacccatcatcttatcaacacgagccttgataaaatccataacctctgccttattttcataagtcaagctatcaaatgttaaagcataaaggctatcgatcagctcatccatagcaatgtgccaaccaaaagcatccaagatacgaactacaccttgagttgcacgacgaagagcataagggtcattagaccctgatggaatcaaacctactgagaagaagctcaaaatcgtatccaatttgtctgcaatggcaagcactgcgccgaccttgctctctggaagttctccttcagctgaagtaggcatgtagtgttcacgaatagcagctgctaccgctggagtttccccagcaagaagggcatatttttcacccataattccttggagttcgtcaaactcaccaaccatacctgtcaacaagtcaaacttgtaaatggctgctgcacgggctaggtcaatcgtttcatccgctgacaaaccagctttttctgccaagagaatagcaatctgaccagtacgaatcatgtgttcacgaagggaaccaattttctcatggaaggttacattgtttaatttttcaacaagatctgaaatcaccaatttttggtcttcacgccagaagaattctccgtcttccaagcgagctaccaagactttttcatttcctttgatgacattttccaaatgatctgcgtttccattacgaacagaaatgaagtttggcaagagtttaccatcttgatcacggacaacaaagtaccgttggtgttccttcatcgaagtcaccaaaacttcttctggaacttcaaggtatttggcatcaaaacttcccataaaggcagttgggtattcaaccaagttcaagacttcattaagcaagtccgcatcaatttcgatatgtacaccatgctcagtttcgattgctttgatttggtcaacaatcatttgctcacgttcacgaggatccgcgattacaaactgcttacgaaggtcttcttcgtagctcaatgctgactgaatcttagtttcttgtcccaagaaacgatgaccacggctcacacgatcacccttaatatcaagaaaatccaagtcaaactcttcttcatctaaaagaacagttaaagtgtgaacagggcggatgtattcaaaggtgttgttagcccaatgcatgctgacagggaaagtcaaggacttcaagacatctacaacaccaggaacaatggcttcaactgcttgaccaatttcttccttggtaacatagacatattcttcacccttgatttcacggaattcgatatcttcaacagtcaatccttttccacgaacaaatccttgagctgctttggtgaagtttccatcactatccaaggcaattttctttgctggccccttaaaatcttctgtcaaatcagcctgtttgtctgcaagaccagttacacgaacagccaaacgacgtggtgttgagaaggtctgaatagcttcaaaagacaggcggttttccttgaggaaggctgccattttttcgccaagttgtttttcacttggtgtgacaacataggctggtaattcttcaagaccgagttctactaataagttttttgtcatgttttttcctttacattttcttcaatcttttttgatatgcaccttaggtactggggacgtcgctaactaactttgtgagtctgtatggaaatctaatactaaattgatcaagatttccaacagtctcatcaaagtggatttagctgactaatttttgaacctaaggtttcaaaaatccccacataacagtacggcggtgcatatccctctagcaagtcttcgacttgcctctaacgattttagagcacaatattactcactattctgcgtcttctgctaagagtttagctcgtgttgcttcatccaaaagtgggtagcctaggcgttttcgttctgcgacaaaggttttagctacgacacgggccaagttacggatacgagcgatatagcctgcgcgctctgttacagataccgcaccacgcgcatcaagtaggttaaaggtatgtgaacatttgagaacatagtcataggcagggtgcaccaatccttcttccaaggcacgaccagcttctttttcaaacttatcaaagttttccaacaacatttcttgatcagaaatttcaaatgaatattttgagtgctcgtactcaggctggatgaagatttctccgtattttacaccatcagcccactcgatatcatagacagagtctacttcctggatgtaagaagccaaacgctccaaaccataggtaacttccgcagtcacagggccagttgccaatccaccaacttgttggaaataagtgaactgagtgatttccataccgtcaagccaaacttcccaaccaagaccagctgaaccagttgatgggttttcccagttatcctcaacaaaacggatgtcgtgctccaaaggattgattcccaatttttccaaagactcaaggtaaagttcttggatgtttgatggagatggcttcatgaccacctggaattggtggtgttggtaaagacggttaggattttctccgtaacgaccgtcagcaggacgacgtgatggctctacataagccgcattccatggctcaggtccgatagcgcgaaggaaagtgtaaggactcattgttcccgcacctttttcattatcataagcctgcataagcatacaaccttggtcattccaaaattgttgcaaagtcaaaataatttcttgaaatgttaatttcttagacattgaatactcctttaatttatattatcttcttagatttatttttcaagcaaccaagaaaaggctgggtcctgaaaaatatgacgtttaggaacagtttgtaaattctgatcgctttcatctattgtacctaatttcaaagcacagacttctggtatattttcttgaacagtgaaaatttgactatgacagttctggcagtaataacgctgttttcctggagaagaactataggaaacaagcttttcttttccatgcaatactagcttttcactgctaactttagcattaactgtataggcagacgcagttgctttccgacaaaatgagcaatgacaaaaaactaattccgataattcctcatctagagtgtaggtcactgctttacataaacaagatcctttaagcattatgctcctttctacttaggcattagacgaattcaaaaagaaccgaatttcaacacccaagccttgcgactaggggcgtcagaaacgcggttccaccctaatttattacttcatttgtttttaaaaatattacagaaagcgccagttctttattttgccctacttggctcccactatcccaagttcgcttgaagaacgccataagactttctttcctgctgactattatatcaaaaattagcacaatgtacaattctttttatgattttctagaaatccatatcatcaactcgtggagcaccagactgaacaacaattgtttttaaggtttcacattccttatgactcagttcaattccaaagcaatcaagattagcctgaatacgagaagctgtgacagattttggaagtggtaaaaatccttctgctaagctccaggccaaggctatctgagcaaccgatttaccgtgatttaacgcgatttcttgcacttgcttgctatcaaacagttctccctgaccaaaagggccccaagcttccaataagattcctttttctcgacagtaatctacgacttcctcttgatacacacctggagccaaacgaacttgattgaccgctggaagaatttttgctgtttcaagcaaggcatccaaatgatggggaaggaaattactaacaccgatagcacggattttgccttcttgatagatgtcttccatcgctctccaaacttctgaatttcggattttccagtggttattttctctgagcggttttggatttggccaatgaatcaaatacaaatccaaatattccaagcccagcttctctaaagactcttcaaaagcctgacgagcttgctcatagctatgatttgtattccagagtttgctggttacaaaaatttcctcacgcagaactccactatcttgaatggcacgaccaacgctttcttcatttttataaatagctgccgtatcgatatggcgatagcctgcctttaaagcctctagtacagcttgatatgcaatctctccattttcagctttccaggttccaaatcccagtactggaattgtaacaccattgtttaaagtataagatttcattatttttcctttctatgagaagaaaatccaaagagccaaattttcaaggaaaacttttctctttagattttgtgtattattgattgcggtcgtaatagatctgatgagctttaagacgagagtctaacaaatctggaattgtcacaaagtcataaccctgacctttcaaatagtcaatgaccttgggtaaagcattcactgtctcaacatggatatcatgcatgagaataatagaaccattcttgacttcacgctgaatttctgtcaaaatagatgcttcatttttactcttccagtccagactatctacatcccacataataaagctcaaatcgagactattgcgaatgtcatctgtaatagccccataaggtggacgcataagtttagaactagaacccagcaccttagttagcgcatcctcagtatcagtaatttgttttttagcttcatcaagggaaagttttgaaagcactggatgactccaactatggtttccaatgacatgtccatccgatttcatgcgtttcaaaatctcttcatttccagaaacattcttacctagcacaaagaaagttgccttgataccatacttggaaagagtatctaatgcttgatttgtcgttgcaggatttggtccatcatcaaaagtcagggccactactttacgatttttcttttcataataagccttatatagctctgcatccttatctaataaataagaggactgaataacttcaaagaaactagatactggcaaggcaatctcgtctagattttcaactgactgacttggataaaggataatctgactatccttgtaatcaaaattccatgcagacaagtcttggtcagagaaacctttaacaacttgatcaatcttttcttgctccaatttcttatcctgtaaaaaagaagtcagttcttttatcagtttctctttggccttactagcatctgaaaataattgatcaagtgtaaaaggtttaccatcttctgtcaaatgtacttttgccagactagttttttcagtctcttcaacttttgaagaagttaaatcatagacttgtttcaccacacttcggttgacaatcccttttaaagttgaatcctgtttctccgtataataaaaaaccagattttccttatcctctagattgtctttaatatcctgtgtcatgattccctttatagacgaaatcacttgctccccttggagaggataataggcaattacttcggcttgtcccttacgaaaatgatctttctgatttccctcactcaattgattatctttatcattttttaaagactcaattttttgttcgaaactttgctttgtatatactttgtatccaatcattgaaccaaggacacaaatacttaccgaaaagatagctaccagggctattaaaccgattctctttttatcgtgctcaacacgttttgctctacttttatccatagagatatcatatcaaattcaggctataatttcaattattttagaggaaatagtatattaaaaagaggggaactccctcttaaaatcttattttactgcttctttcaaagcatctaccttgtccaaacgttcccatggaaggtcaatatctgtacgtcccatgtgtccataagccgctgtttgacggtaaattggacgcttgaggtccagcatttggataattcctgcagggcgaaggtcaaagatttgacgggctgctttttcaagcttgctttcggctactgttcctgtaccaaaggtatcgatacgaacagagacaggctgcgcaacaccgatggcataggccaattgcacttctgctttcttagcaaggcctgctgcaacgatattcttggcaatataacgagccgcataagaggctgaacggtccaccttagtcgcatctttaccagagaaggcaccaccaccgtgacgagagtagccaccataagtatctacgatgatcttacgaccagtcaaacctgagtccccttgcggtccaccgattacaaaacgaccagtaggattgatgaagaatttggtttgctcatccaagtaagaggctggaataacctctttgataaccttattaatgacatcattgtgaatttgttcgttgctgacttctggatcgtgctgagttgaaataacaactgtgtccacacgtactggacggtcattttcatcatactcaaccgtaacttgtgatttagcatctgggcgaagatagctaatttccccagacttacgaagttctgccagacgacgaaccaatttatgactgagtgaaattggcaaaggcatgagctcttctgtttcatccactgcaaagccaaacatgagaccttggtctccagcaccaattaagtccagcggatcttgatctgcatttccacgaacctccaaggcttcgttaacaccttgggcaatgtcaggagattgttccaccaaagatggatgtactcctacagtctcagcagaaaaaccatattctgtattagtgtagccaatctctgcaatggtatcacgaaccacacggttaatatccacataagcatttgtagatatttcaccaaaaacatggactgaaccagtatatacagctgtctcagcagcaacgtgcgcctctggatctttagctaaaatagcatccaaaatcgcatccgaaatttggtctgcaatcttatctggatgcccctcagatacagattcagacgtgaataatttacgttctgacataaaaatgtccccccttaaaaatagtgttatagagttacaaagtactgataggtattttcattttctaagagttacaacgcgtaagaaataaaaacgatacttttttatttctgaagctagtaaggcgcatagggtgaccgcattatagcggcaaccgtagaatgacgaacgacttttgagccgtcattctttgcgagttgcgactcgaaagaaaaaatagaaatttctaccatcttatcgggactatataactttaccattataccatttttaaactcaatttgcagtctataatgtagtgtttctgtatagatagttcgttctcataaaacaaaaaggatttaatcctgttatatacagaattaaatcaaaatctgaattgtttttaaattttttatactctctaaaaacacctctataatacatactcagacctaatatagcaataaatttatgaataatagtatttgatttgaataaaatgttaatgactatcccagtcattataaaactaattgcaattatcaaacgctgcttcatttgtacctcaactttctatttcgtagaaaaaaattcagttcctatccaaaagcctataatagctccaccatatccccttaaagaaacaatcccttctcaaaacatgagagttcaccttcaatgctggatagcattgcttcatccattacttcaaattgtttcacctttgtattcatcacgaatatttccttacatttatattaattttttatcttgttacaaatttggtaagttttttctgctcatttttccttatctcgttataccaaaagaaattaatccttgagctagatttttactcaattctccatatgtggcaatttctttataaaatgtcgcaacctttgggctcaatgatttctgactatgaatcccactaacagcctgctgacgaagagcttctgccaactccatgacaactctctgttcattttttgtattctctaatagagttttataacgtaataaaatatctcgttcatttttatgaatctctgtatctaaaatcaaattgtaaaccttattgagaatttcttctgttctcttatccataaattatcctctataacctgaaagacaatagctcctacccaatgatgatatccaaccattagccatgacatctttagttaactcaaaatcacacttagttacaatatccccattctcaatttggaaattaacagatgaaacattgtccaaacatgtaatgaggcgaaaaagtatcgtcatcacaaccttataaaattcccttttggtttattccttttaaacctatacaaattaatagtagagtggctatgatatcaacaatatcttgtgactttagtaaagacaagactcctagagaaataatgtaaaatatactaattacttttctcgttataaacaaaaactacctgccgctagcccgcctgttgaaatcgcaaatgcaacaccaacaagaccagtaaatgcagttagacctatataaattgacataccaactcatactccacaagtgggatttaatccaccagagtactcttgtaaatcactgttttttagaattgaaaactgactcattgaactattcattgtacatcctctctttttagcaaactcgcatagctgtatcaccacctagaatcgcagcaccagcaggtccagcgtataaaaagcctatctcagtcatccctgccctacctgaaatacatgccaaatcatttttacctccttcaacacaataatagaaagagcatcagctttgaacacattaacttgttctattgtttttgtatccatgatgaatatctcgtatataatagaaatcttttgtcagattataaccttgacaagttcagtatagcaaaacaaaatcgatttttatcacaaagtatttacatgttgctaactccacttatcttcaaatttaaatagacacattatcggagttatcaaaaagtcttgaaaaagtccagaatgattataatctgattaccaaaaatatgatttagacataattagttaatatcattctgcattactagtttaatttgatacagtgcaaatcgaaaaattattagcaataataaaaagccatttccaaaaaacaagaaatacattgctaaatcactctttaaatagtatagaaaccaaataagcatccaaagtatgctcatttttataaagatattacttactatccattcaatctttagcaagagataattaactatgttcattataacaatctccatatttccatcctcatcatatctatagctcaatcactttactactatgtctcaaaataatttattattatatactataagtaaaacgctaactcattctttttttgaaatatgtaattcgatattattcgagcaaataatgtatactactgtaaataacactacaaatatatgagtataaaataatacagatgacgacttataaccatctataacgacaaaaataattgataatagtaacagaaaaaatgtaggtgctaaaatctttttaataaattgcttgtatcgattaaagcatagttcaaaactaatgtttcctctcttcttattatgcgttaataagtgaatcagcaactcaaaaaacacactacctacagaaagaactaaaacttcgcttattggaacatttagaactattccaatcacacctattataaaaaaagatataaaaagagctaaaattagcctaaattcaccactttccatcaactaaccccttttctataaaaatctagcgatagcccatatagctgtgcaatattgtgctcataaaacacctccagcccaagttccagctcttggtgcaaccaaactaccaatcattgctcctgctaatgtgcaaacttcccctgcactagctgttcctccctcaatactagccaacatttcggtatccaaaacatcaaattgaatcgttgtctttgtttccatggggaatacctccatattaatttttattatttttgtcagattataaccttgacaagttcagtatagcagaacaacagagatttttaccgctaagtcttaaaatgtacgattttcatcacgaaacgtattttttcatgatttgtaacctttcaagattaaaaataaatcattttaaaatttattccacaaatcgctgctagatattgtgaagtcgtcactctagcttttttgcccagttttattgttatgactatttcctaactcatttacaggaactagctaaaaaataatgtatataaagtcataacaaaagaatcccccttaaaatattctatagaatattttaagggggattcttttaaagttctatttccaagatctgtgtaaagacataatttttacttgttgttttcaaacatacatttggataagattttaaaattctccgaacattggccaatcctataccccgacctacgccttttgaagaattgtcacgcttgaatatatctctcaattctatctctctttctaaagtagaattttttacaatcatgactaatttattccattctgtatcctcaaggaaacaaactgctattcctccttctgctgcggactctatagcattatctaacaagatagaagtaattgttaagaagtctatttgttccatattttttatagagaactgttcaccaatctccagggaaactggaacagataagttttgggcctccgataacttagataatagtaaactctttaacgccaaatcattgatatttcttagatgtgctacatcaaaacgcttgccttttaatttttcaccagaatttttcaaaacactatcataaacttgagaaaccagattaatatctttttgatctatacctatttttaagctcgataaaatattagcataatcatgtctaaagcttctaatttcttgatacagcccctcaacttgttgactataattactaagattttgcaattgaatttctttttgtagaacgactttctcctgtagttcttgaagtaatcttctatccaagagattaacaaaacaaataaacaataaaaagtaaactgctgtccataattctttataatccaacattctatcccaacttactttatcactgtagtttatataagatggtaagataaaataggctagcattaaaatatccgcagtaattaaaataaattttgtctttctatccaagttctttatttttaaatgactaaaattatatcgaaagagactaataagaaaaaacacaataatttcagctaataaagagaaaatcattgttcctagattagtttcatatagtctatacaatattggaatcttagaaattataaagtaacctaaaaaatttttgatgacatcccaaaatccaagtggaaataatgagtaaaaaagtaataaagaaaccttacttcttaatttaccaatagacaaagtatataggataaaaaaggtaggataaagcaataatgacccaagaaagtaaaatccagttgatttaaacaaaacaataaatagtaatgataaaagatggaacagaataatggacattactactttttttagatttaatctctcacctacaaccttagtatggatacataacaatagaaaaacacctataatatttagaaaaaatatcatctaaatctccttagtcatgaagtctttcgataactttcataagtggacgaatttttaatctagagacaatacaagaggacccgttctgaaaatgaactaaccgattttctttatcaattaaagatatattataaggatttacgataaatgatctatgacattgaaataaacgtggttcctgtttaagaatatctgacaattgtccataaaattcaactatgtctcgttttgaatagagagtcaacttatgagcaattgttgatgtttcaatatacaataaatctttaaaagggacttgaatttgagctttggatcctgtaaatataaaagagtcctcagatactgttattccttgattatcgctaacacttaaaataacattttcaattcgtttgataaataatggttcaggtaattctttatcaatgaaatcaatagctgatactaaatattcaaaagatacaggcataaactcagaatgagatgttacaaaagcaatcactgcttgagaatcaagttttctaatttctctagcaacgtctaatcctcttttgtcatcatcttttatttcaatatcaagtaaaaataattgatgatttcctctctctgaaatgtcctctaaaagctgttgaggttttccataaacctcaaaatgcctatactcaatcttattatccaccaaaatttttttgacaacattttcaattctagtctgttgtaaaaaattatcttctagtataaaaatattcactacttcactcctatatatttttccactgattttttaatattgtaaagtgtcttctagaacaagcgatgtctgatactctatcatccataaacataatcgttcttgtctcatgattaaatcctgctattttatctttattcacaagaaactttctatggcatctaataagttcttctgtactttcctcttcgattttagctagtgaggttgaagcttcaaaattcccttctgctgttacaaaaagaacagcatgagcttttgtagggtgagttgtaacataataaattttagagagtgatacctttacgatagctctatcttgatataaaatgtagtctttcatatttagcctccttctatcagtttaatcttatcagaatgatggaaattaaattataaaaatctcaaatggtttctatactatctcaaatggtaaaaattttcttaatttagacatttcatgataaaatagatactttttagtatctcaataatattaatctttcttcatttgataaactaatttctaatgaaaggaaagctatgaaggcaattcaaattttacactactctttatttggctatattttatctctgtatttaaaatattatttcttaaaaaaacattcaaaaatacaaaaattttacaaggacataagattaactacaaatataaatcttctacttattttatcataaaatcagggtctctaacatctaaaaaaatgaaactctatttaaaatctatccaatttagttcaaaaaaatcagaagtcatcatcataggcagtcagattgattatgatgagctttaccgaaaccactatagtgtgtttggtgttatagacataactaataataaatcattaaaatatattaaagaaaaaattcatttttacttggaagagctctatgaatttaagaaggataagagtgattaagtctatgaaataaagtttcaagtcttataactttatatccgtaatcacctatccattaattttgatttcttcctccatatgctagagtttgatatcaaattttagtgtcatcttaaagtagtcatattttgtcagtcttcttttttctgaattattgaaattgattagaacctctactattttattgatatgagctagtttattatgtgactttcagtcacataatagaaaaagttggagctcagtactccaactttttctattaaaatgtttggcgttttgctttacgctctgcacgaccacgtgcgcgattttcagcgcgcttggtcttgcggcgtttttcatcaaccgcccattgaattttcttcttataacctggtttgacttttttctttttctttttaaccaaaccaatcatttcgatatcaagtttatcttgttttttctcacggttggcacgacgatcacggtcataagtatcttgaaattccccgtctttgaccattttaggagtaaacttgattcccaatttctccaactcacggatatccgagtcatcactgggttggtaaagggtaatagctgtacctggtaggccatttcttccagtacgaccaacacggtgaacaaagaaagataaatcttgcggaatggcatcattgatgacatggctgacaccttcaatgtcaatcccacgcgctgccaagtctgttgcgacaatgtactcaaaatccagatttttcacctggttcatgatacgcttgcgttcacgaggggcaatatctccatgaatcttcgctaccttcaagccttgagcagtcagatatgaatgcaattcatcagcacgcattttagtgttaacaaaaatcattgccaaatacggttgcatcaactgagttaactggtaaatttgagcattcttgtcacgtccctttgtagaaatcaaccaattatcaatggtatcagaaatgaccgttttggtcttgattttctccataacaggatttgacaagtattttttcaagaatggttgcagtttttgtgggatagtcgctgagaagaccatgaattgcaagtcttttggaaggcttccagcaatcttatcaacagtttccaagaatcccatatccaaggtcatatctgcctcatcgaccacaaaggtcttagccttgtgaatagctaggtcaccagacttaactaagtcataaatacggccaggcgttccgataacaatatgaggctggttacttgccaatttgtcaatctggcgagccttatccgtaccacccacataattaaccacacgaacttcgacatctgagtgggctgcaatctgacgggctgcttggtaaatttgagtagctaattcacggctcggtgcagtaatgactgcttgaacactatcgtcggcttcatctaattgctggaaaatcggcaataggaaagtgtgagtcttacccgaacctgtttttgattcaccgactaggtcacgacctgtcaaaacaataggaatcaacttgtcttgcacctctgttggagttgtaaatttcaactcctccaaggcttcactaatatattttttaaattgaaatttcgtaaatgacataatatcctcgattctatctatcctatcaattataccatattttattccatttcagtagtctcacttatttaggctatttctagtagcttctctagtaaaaaaggctggaatttgtgaatcccaacctcttttcagtcattatttccagtttaaaatagcattcaagccatagtgatcactcacttgtggactcttgttaccatcaaatacgacatgtaaattttccaccgctaactccttggtagtaaaaacatagtcgattcgaaggggttcagtgttccccttccatccatcaatttctggtggaacagtatagctaccacttttctcttgagcaacttcaaatgcgtcttgtaagcctaatggactagctaaaatagcttggtaaccttcctgaccagctgggttgttgaaatctccagctagcaaaagcggcttgttcaattctttcaagacagcctcaattcgtgcccattcttcttggaaacctttatcccaccaagaaaggtggacactggcaactgcaagttcattaccatcgactacagtttcagccagggcgacacggcgagtatgatagtctgttggatcatccacatctgaaaccaaaatttctcttgcttcaataggtgttttagacaagatagccacaccttcatgatagcggtcataaccaatatggttataggcccaagtccaatagtaattttttccttgctctgacaacttttcaaccaaaagtctaacatagtgatcttggtgaataggctctgctgctggcaaagcttgataaaagtcattcacctccacctctagcgaagtgatctcctgattgatttcttggaaacaaatcaaatcatagtctttatcaagaatatcctcaagcaagagctggaatttttcctcagcttctttttccatccagctatgagtattgagtgttaaaaatttcatgcttttctcccaaaacaagaggttggaaaacagcttccaacctcaagtgtattacaattctactttagcaactgctgttttagctgcaagagaacctgtttgttctaatttaactgatttaatagcttcagcatttgtgaagacaaccactgttgaagtttcacgacctgctgcacggatagcatccaagtcagctgtgacaaggagatctcctgctgcaactttttgtccttcagcaacatgaactgtaaatggtttaccttcaagacttactgtgtccaaaccaatgtgaaccaatacttcaagacctgcttcagtcacaagaccaagagcatgttttgtagggaagatgcttgatacagtacctgaaactggagatacaatgtttccatttgcaggttctacagcaaatccatcacccatcattttttgagcaaatactggatctttcacttgttccaaagcaacaacttgaccatctgctactgagtaaacttcctcagtaagacctttgaagtgtacagtgttttgttgcgcttccgtcatttgacttggaagagtttcaggaatgatttcacctgaatcaaggatatcttggatatcagatttcaatacgtctgcttttggaccgtagatagcttgaactccttgtcctttcatgacaagacccatagctccttctgctttccattgttctgcatcaccgactttatcagcatcttttacagttacacgaagacgagtcatacatgcatcaacatcaacgatgtttgcacgtccaccaagaaggttgataatgtttacagcttgagaacctgctgcaactttcacttcgctgctagcttcttctgaaccttcagcagtttcgtagtttccgttacgtcctggagtggcgtagttgaatttttgaatcatgaagtttgcgataaagtacatgattacggcaaagagaacagttacccagataaagttaacaatatccataccgataccagcgctaatcgcaataggtgtacgagtcaagaactcgattgaaccgaatgagtgcatacgtaggtttactacgtcagccatagcgaaggccgcaccttgaacaagtgagtaaacaaggtacataggtgttgctacaaacatgaacatgtattcgattggttcagtaacccctgtcaagaatgttgcaagagctgttgcaatcatcatacctttgtatttgtgtttcttgtctgcatcaacattacggtagatagccacaaccacacccatcaagataccgaatgaaccaatcatttgtccaactttgaaacgagctgggtgaacagtatctaacaagtgttggtattgagtagcatcagtacctttaaggtttacaaggtctgttacccatgcaagccaaagtggatcttgaccaaatacttggctaccttttgctgcaccagttaagacctcataagtaccaccaagagctgtgtagttcattgggatagtcaacatatggtgaagaccaaatggtaagagcaaacgttccaatgtaccatacaagaatggtgcaaggattggagcagtttcttgtgagttagcaatccagataccaaagctattgatacctgtttgaactactggccagaaagcagcaagtacaattgcagcaattattgaacgaagaataactacaaacggtacaaaacgttttccgttaaagaatgaaagtgcatcaggaagcttacggaagttatagtatttattgtaagcagttgctccaataaaaccagaaataatccctacgaacacacccatgttaagtgctggagcttccataacactaatgaagtaatcagcaactttgattgatccaccaaagagagttgttaccatagcatctggatttttcaacatatcgcctgatacgccaaagattgtaccagtgatacggttaatcaagatgaaggcaagaccagcggcgaaagcaccaccagcacgttctttagcccagctacctccaatggctagggcgaacaagatatgaaggttaacgataaccccccaaccgatttgttctagtacaccaccagtaataacaagtggtgcaaaggttgggttaatcatcacgatagacttaccgattgaaatcatcaaaccagcagccggcataaccgcgataaccaccatcaaagccttaccgaatttttgccaaaactcgaaagacaagacatttttgaatgtatctttcatcattcaaatctcctttatttttatttaggcaaacgttttacgaaaacgtttgcactttctataatttaattataccactttaattttttttgtaaaggcttttataaaaaaaagtagacttttttctaaaatttttgtagtaaaaaaggagatattaaaatctcctcaaatatacttctattttattttagattttcaggaatcggcgcattgaaattcctgatccgattgaaccgataaaaattccaatcacaaataatagagcaatcatcagtggactgaatacttctggtgatatcattgaaaggttctgaccaaccaatgacttattaaccgattggtaaaccattttatagacaataaataccagaactgatggaagtgttgctccaagcaaaccaatgaaggcaccttcaagcaagaaaggtccgcggatatagccattcttagcacctactaaacgcatgatttgaatttcacggcttcgtgaaataatggtgatacgtatagtattagaaatcaagaacaccgcaatgaaaatcaataatccagcgataactagtccccagacacgaataaatgaggctaacttaaacaagcgttctgtattagcaccaccatcttgaacttctgatacaccttcgatttttttagcttcttctgctactgtctttacatcactgggtgtatttgtatcaacgatatatgcatcataaagaggattggcatcgccttcaaagattttccagttgtcccccattgtttctgtcaacttttcatattgttcttctttacttgaaaacgtaacacttttaacggttgacatacctttcaaagcatcatataccttatggtagtcgttatttgtaacagtttgaccttctttttcaatcgtctcactattatcagctacgtccttacgaatgtataccattactcggacattattttcgatatctgtagctagtttagccgtattaaagataacagatgcaaatattgcaaccaaggtcaaagtaatcataactgaactaacagcagctactgtcatccagccatttcgtttcaaactttttaacgattcaaataaatgacgaaaaaatctactaatcatcgtatccatattctcctttagcttcgtcacgaacgacacggccattttcaatggcaatgacacggtggcgcaaggtatttacaatctgactgttgtgggtagccatcaagacagttgtaccttggagattgatgcgttccagcaagttcataatttcccatgaattatctgggtccaagtttcctgttggttcgtccgcaatcaatacttttggattgtttacaatggcacgtgcaattgcaatccgttgctgttctccccctgaaagttcatttgggaaagaacgaaccttatgcttcaatccaaccaagtctaagacttccataacacgttttttgatattacggcgactttctccaattacctccattgcataagcaatattttcataaacggttttctttggtaacagtttataatcttggaagacaaccccaacactacgacgtaggagaggaacatctttctttttaattttaaccagattaaaaccagcaacagataagcttcctttttcgatttttacttcgcgatacaaagaacgaataaaggttgatttcccagctcctgaaggtcctacgatgtaaacaaattcccctggttgaacgcttaccgaaacaccacgtagggcagtcgttccgttgtcgtattttttgacgacatctctcatttcaataattgacatgtgagttcctttctatcttagctgattctccacttgagataggcatcaataaaaccatctaggtctccatccataaccttatctacttgtgcaacttcaaagttagttcgatggtcttttaccatagtatatggcgtgaaaacataagaacgaatttgacttccccatgtgatttcctttttctcacccttgagggaatcgacttccgcagctttcttctcctgctccatttgatagagcttagcctgcaacatcttcatggcacgatctctatttccatactgggtacgatcgactgttgactgaacgacagttcccgtaggaatgtgtgtcaaacgcacacctgtggaaaccttgttgacgttttgtccaccagcaccacctgaacggaaagtatccatcttgatatcatcttcacggatttctacttcaatagtatcatccaattctggcatcacttctacagatgtgaaagaggtgtggcgacgtttagcagagtcaaatggtgaaattcgtaccaaacggtgtacacccatttctgacttgagaagaccataggcattaggtccttcaaaagataaggttactgacttgataccagcttcatctcctgcttggtaatccaatacttccactttaaagcctttagcatttccatagcgagtgtacatacgaagcaacatatcaccccagtcctgagcctcagtaccaccggatcctggatggatttccaagatggcattattatggtcataaggttctgacaagagcaaggtcatctcgtaactggtcatcatcttatcaagttctgacaactgttcaaccaattcttcatgtaccgactcatcttcagctaaaaagtctaataaaatttcaacttcatcctgcaactcttccattttgtgaaaggtgttataggtgttttttaattcatttaattcttgcgacgttttttgggccgcgatattatcgttccaaaaatcaggttctgtcatcttgttttccaagatggcaatctcttcctctaaaccttcgaggtcaaagagaccccctgaaagaagctaatttttcacgatttgcgtcaattttctgacgaatttctgaaatgtccataaatactccttttttacattatttcattatagcatattttatcatttctttccatcttttgctctaatcccttattacacgtaaaaagaagcctttcggcttcccttcttacaagacttttgctgaagtacgagtaatctcttctacttgaatattctctgattcaaatttttctttcaaggctggtaaatcaattgatccatcgatttgaacttcgataatgaccttaccatccttacgcggaatattgactgtatgcgagatattcaaattttcttctacaatcaaagaaataatttttccaagaacgccaacttcgttttccgtaacaaagcgcacacgaatcccttcttcaccataacctgcaatttcaagaaaggcttggaaaacgtcacgatccgtaataactccgtatacttgatgattatctacgacaggaagaataccaatcttatttttcaacatcagataagttgcatcctctagactcgcatagcctgaaacagtgacaacatcgcgaatcatcacatcttttacttttgtcttatttagaagataattcatctcatagatagaaagacttgttgctttggatggactagcttgggcaatggttccctcagttaccaaaccaaccaattgatcattttcgataacaggcaagcggtgcaacccttgctctctcatcaaatctgctgcatgagatactgttgtatccggactaatataaactaccttgcgggtcataaaatctttaactgccatgagacttctccttttctattcttatccctattatacaatctttttgtaaatctatcaaacgcttacatttctttttcaaaattcagaaaagtatgaataagctagcaaaaagagctctgaaatagagctctctgaatgaaggtaagatacatttcattcgattttttcaattattagaaattaaccttttaatgtagataaagattgctttacaatctatatctgtcaactaaaaaggtcccctggactataatgatgattacttcgtaatcctcatccaccgactaaaacaatccagtggattgttttagccacctaggtatgcttttctgacttcttctgatgaagcgagttcttttcctgttcctgatagaacgattttccctgtttccaatacatagcctcggtcagagattgcgagtgctttattggcattttgttcaatcaagaggacggttgttccttgtttctggatgtcttgaatgatatcaaaaatctcttggataaagattggggcaagtcccattgatggttcatctaaaagaagaagttttggtgttgacatgagggcgcgtcccatggcaagcatttgctgttctccccctgaaagagtagctgcatcttggttcttccgttcttcaagacgaggaaagcgtgagaaaactttcttcaagttggcttgattttcttcacggtttttctttaagaaagctcccatttcaagattttccataacagtcaagccaggaaagacgtggcgtccttctggaacttgtgaaagaccacctgccacgattttttgagctggcattttttggatttcttgacctaaaaattcaatctttcctgaactcggtctaaccaaaccagacaaggtacggagaatggttgtcttacctgcaccattggcaccgataagggaaacaacctctccttcatttacttcaaagcttacatcacggactgcttggatcataccgtaatgcacagaaagattatcaacttttaacatagacattaggcttcacctcctagataagcttcgataacgcgtttattggtcttaatttcgtctggagttccctgagcaatcaaacgaccatattcaagtacgtagatacgttctgtcacttccatgaccagattcatatcgtgttcaatcagcatgatcgtaatcttaaattcatctttgatacgacgaattaactcagtcaattcggctgtttcctgtgggttcatacctgctgctggttcatctaaaaagagaattttaggttccgtagcgagagcacgaacaatttccaaacgacgttgttgtccgtaggcaagatttttagcaagagtttctgcatcaccatctaaatcaaagattttcaacaattccaaagccttagcctttaattctttttcactcttataaaaagctggtaagcgtaagaaactagcaaaaacatgttgtttgtgatggttgccaaaagcaatcaaaacattatccaaaactgttaaatctttaaagagacggatattttggaatgtacgtccaagtcccaaagaagcaatcttataaggtgactttccattcaaaaggtgaccatctagggttactgttccctcacttggttcataaacacccgtcaagaggttgaaaagggtggttttcccagctccgtttggaccgattagtccaaccaattccccttcgttcaattcaagagtcacatctccaacagctgttagaccgccaaaatgtttggttaactgttttacttcaagtaatgccattagttttgttcctccttcttagattttttaaagaaacgtgataggctcaattcccatgttccaagaagtccgcctggtctgaaaatcattaccaataccaaagccaaagcgtagataatcatacgcacgctagcaacatcttggagaagcatattcaaaattcccagaacaatagctgaaacgattgcacctgtaatggaaccaagtccaccaaatacaacaataatcaaaacattgattgagttgatgaaagtgtaatctttcggtacaactgaaccgataaatcctgcctgaagtgaccctgcaatacttgcagtaatggcaccaaagacaaaggcgatgattttaattttagtcgtattaaccccaactgactcagcagcgatttcatcctcacgaacagaaagggttgaacgaccaattggactacgcaagaagttcaaggttgcaatagttgtaatcacgacaaagaagtaaaccatttgccaagttgtaaagttaggaattcccaagatacctgccgcaccatttgtaaggcttccgccattgatgataaagatacggataatttcagaaacacctagagtcgctaccgcaagatagtcccccttcaagcgcaaggttggaattccgacaagcaaggcaactgctcctgaaagcaaagcccctacaagcatagctccaaagaaggcaccgtaggttggtgatttagaaccaataatagctgctgcataggcaccaatcgccatgaaaccagcatgaccaagtgaaaattggcctgaaaaaccaacgattaagttgagaccaacagccagaataatattaattccaatttgttgtaaaatctgtacatagaataggtttagtactccaactgaaaccaatacactaatcaagccatagccagctaacaaaaggagtaaccatagaatattaacttttaaattttctttcatcgtttacaccttctctttcacatttttaccaagaatacctgctgggcggacaatcaagatcaacaacaggattccataaacaatggcatcacggaagtctgacattccaaaggctgtcgcaaaggtttccaatagaccaatcacaaagccaccaagagccgcaccaggaataattccgataccaccaagtactgcggcaacgaaagacttaagacctggagtaacccccatcaaaggctcaagagagttataataaagggcaatcagaacaccagccgcacccgcaagagctgaccccaaagcgaaggtaaagctgatagtacggtttacattgatccccatcaattgcgctgcatcgctatctacggatactgcacgcatggctttccccatcttagtcttttggacaatgacttgtaacaaaatcatcaaaatcaaggaaatggccaaaatcattaactgcacgtttgttaggctaactggtcccaaatcatagcgaactgtttgaatcgcttgagggaaggcacgggtattagcaccaaccagatagaccatcccatattccaataggaaagaaaccccaatagctgtaatcaaaacagcaatacgagtagagtgacgcaaaggtcggtaagcaaggaactcaatcacgacaccaagaatggctgtcgctaacatagctacaataagagctacaaagaaattcatttggaaagaattaatcaagaaataaccgataaaggctcccatcatataaatatcaccgtgggcgaagttgatgagcttgataattccgtaaaccatggtatatcctagggctaacagcgcataaacactacctagaatcaaaccatttactagttgttggagcataagattcactctttctatttataattttgagggtttcccctcactttttgataggttcttaaacatcgaaacagggagtgagtcagaggctcattccctatttcaacatttttctattatggttttacaacttctgctgcttcaaccttaccattgttcatggtcatcatgtaagcagttttgactgtgttgtggtctgcatcaaagcttgtttgaccagtcacaccttcaaaatcttttgttttagcaaggttatccttgatttcaccagagtttttagcaccttttgctgcgtttgctacaaggtgaactgagtcataagccaaggctgcaaatgttgaaggctcttcgttgtacttagcacggtaagcatcaaggaaagcttttgctttagctgaaacttctacagtagttgagaagcctgagataaagtagatgtttgatgctttttcaggagttgcttgttgtacaaactcttcaccgttgaatccatcaccaccaacgattggtttgtcaattcccataccacgcgcttggtttacaattttaccagcttcagtgtagtaaccaggaacgatgatagcatcaaaatctttccctttcatttttgtaagggctgcttggaagtctgtgtcacctgctacgaaagtttcatctgcaacgatttcacctttgtaagcttcacggaaggctttggcaatacctttagcatagtcgctagcattatcagtgtaaagaacaactttcttagcttgcaatttttcagaaacatagtttgagataatttttccttggaagctatcttggaaagttccgataaagaggtaatcttgacctttagtcaatccatcttgagtcgcacttggcgaaatcaatggaacacctgcttttgtagcgttagctaccgcagctgcagttgcaccagatgtcgcaggtcctacgattgctgatactttagattgggttacaaggttagttgttactgaagccgcctcagctgtttcagacttgttatctttatcgactacttcgatttgttttccatcgataccacctgcagcattgatttcatcaacggcaagttgggcacctttttgttcagatgtaccgtaggctgctacggcaccagtttcttcaaagttaaatccaattttgattgtcttttcatctactgaattaccagcagcgtttgacgctccagacttcacttctccacaggctgcaagaagtgctacacttgcaagcgccacaaacgatagggcaaattttttcttcatcttttttgtctccttattcttaaataaatagcatgttaagaatataccgaattatcagaaaattgtcaacacttttcttagactttttcgatgataacgttttcctctcgataaagattgcccacaaagggtgtttccaactcttggatatgacaaactctaactttttttataaatttttccttgcccaagcgcccgaccaattgctccacttcttgagttggaacataaagctgtaagtaacgatgtttcttggaatgataggtaatatctccataatcctgcagttttttggcatcacgattatagtaaagatagataatcaagccagatcgattgactttttcaaacatgataaatcctctttctaagaaatctctccctattataccaaaaaaagcaaacccagtcgagtttgccttctatcaccattaattcaatgaattgttggccatgatttcatcaataaagccatattcaagtgtttcctgggcgctcatccagttatctcgttctgcatctgcatggactttttcgattgactgacctgaattttcagccaagattttttccaaagtattacgagttttaagcaagtgttctgcagcgatcgccatatcggtttgctgagtacctccacctgtaccacccattggttggtggatcatatactctgcatttggaag

SEQ ID NO: 66 - DNA, 71904 bp, Streptococcus mitis NCTC 12261 contig12
tggaaaggtaaacacttccactctattattgtatatgctggaacctggcgatgcccttgtcatgaacgacacccgagttctcccagcccgcctctatggtcaaaaggaagaaactggaggtcatgtggaacttctcctgctcaaaaatactgctggagatgagtgggaagttctggctaaacctgccaaacgcctcaaggtcggtactcgtgtcagctttggtgatggccgtctcagcgctgttgttacggaagaattgactcacgggggccgcattgtccgctttgagtaccaaggaattttcctagaagttttggaaagtctaggagaaatgcctctgccaccttatatccacgaaaaattggatgaccgtgaacgctatcaaaccgtctacgccaaggaaagtggctctgctgcagcaccaactgctggactacacttcactaaagaactgctggcagaaatccaagctaaaggtgttcatctagtctatctgactcttcatgtcgggcttggaacctttagacctgtttcagtcgacaatctggacgaacacgaaatgcactcagaattctaccagctttctgaggaggctgctgccacccttcgatctgtcaaggaaaatagtggtcgcgtcatcgctgtcggaaccacttctatccgcaccttggaaactattggttccaagtttgatgggcaaatccaagcagattctggctggaccaatatctttatcaaacctgggtatgagtggaaggtcgtggatgccttctcaaccaacttccaccttccaaaatcaactctggtcatgttggtttctgcctttgcaggtcgcgaattagtcttagatgcctaccaccatgctatccaagaacactaccgcttctttagttttggcgatgccatgtttatctattaatttcataatgaaaaaacgcatattatcaggcattataaaaacttgatagtatgcgttttgctatggataaaaattgagttaatttattctcaagctcggatctttcaagctctgaacactggcattgataaccgcgccgacaatcaaaatcttagcgatgagaataaaccagaacatcatgaccaccacgacgacggaactgaaaaaacgcacgtctactaggcgattgacataattgttaatatagactgaaaagatattgagcagtaagaccagagtcagcatgacaaaggcactacctggtaatacagagcgaattcgtaggaccttaacattaggcaggaagtaataaagcatgaccaagattgcaaaaatcaaggcatagacctaggggcctgttaggtcttgcagataatcaaagataggactatccgatttccagtagctcttgataaggttgagaagcatgcgaccaaagacactgagaaagagggctaaagcaaagagaatctgcaagccaaaactgacaaacaaactcataagctgatgggaaatcattccacgatttttagctactccgtaagctttattaaaggctttctgtaggaaattcatggattttgaaaaggtccatagagctgacaaaaccgcaaaactcaataagcctgttgacggttgggtcagcacttctgtaataatctttgcaaccacatcatacatggtatcgggcaaaaattcattgacaacctttaaaaaattagaaactggaatccgaaaataagggaggatattaaccaccaccaaaagcagggggaaaatcgaaatcaaccaatagtaggctactgcgacactggtcaactcactatctgatgcttgataataatgcaaaaaagcttttaataagggcttatctatcagctctttccaccactttttcatgtcacactccttcacttataatcttatactcmatgaaaatcaaagagcaaactaggaagctagccgcaggctgtacttgagtacggtaaggcgacgctgacgtggtttgaatttgattttcgaagagtattaactaatttcttcttaccaattccaccatatcataaggcagggtattggcagcttccttcaaggaatagttctctaggttatttacattttgtcgtaacttcttggcatacttggtcgtaatcaatcgtttttcttcgtattcgaaaatcaacttgcgctccagataatagcctctcagcatttcatcgatattgttgggtttgacacgattgataacccgttcgacaaaggcaccactggtgataatagctgtttctctgagacgagaatcctgcatgaaactgatcaaagaactcttataaaccccttttaggttctccagactttcgataatcatctctgtattttctagatagagctctgcaatttgatcatagtcaagggctctgagtttctgtgattcttcatttttccaactgcggaaggtcttgccaaaggtaaagacttcgtgtaggagaaaacgtaaaatccgcaaggaaacaaggaaataataggtcaatcgtgacgcaaacttacgattgatactttgttccatgtttttcaaataacgttggtaaacccgataagcacgctcactcatcttgccttcttcgtaagcctgttctaaaccatcactttcaatactgaggatgagaagttttaagccctcccagtcttcttgagcccccttattttcttgactcaggatgagattttcaatacgtccatgataattgtcaatagccgcatagagagggagcttatttctggtatcttccaactctttttccaactctagcgttacttcattcaaaatggcgatatgcataagatagtccttgctttcttcctgttcatcagaaagatgaggcaagaccacgaggcctgttaaaaagcttacaagagtcacacctgcgacaaggaaaagcaagagaggatactcctgttctagattacttggtatcagaaggatcgtagcaatcgacaccgttcccttgacacctgagaaagtcaaaagaagcatgtccttcatatacttatttagttttttcttaaggcgtcgggtcctataagcataatagccataaatcatgacaaaacgaatggcaaagaggacaaaggtaagggctataagagataccaataacagtaagggattatagattgggttggtcaagataggctctgctatcatttccaactccatccctaaaatcacaaagacagaaccgttcagcataaaggttactgtatgccagaccgtctcggtcaccgtatccacttgggcttcaaggagcgtaattttcttaaaacggcttgcctttaaaatcccagcaactacaacggcaataatccctgaaacgtggacttcttctgccaggaagaaggttaccaagggcaaactcaattctaataaaagttcgctggcaatatccgttgctcgtacactaagtaagaaactatggaggaaacggttggtcatggctgttaaaaagccaatcaaaaaaccgcctaggattgaaaagatgagcgaactactcgcttgcccaagggaaaaggccccagttgtccaaactgtcaaagctacctgaaaggcaaccaagccagaagcatcattcaagagtccttcacccttaaggatattggacacgcgcttaggaaagctaaaccgctccgaaagagaggcaaaggctaccaagtccgtagggccaagtgccgccccaacagccaagcaagccgccaagggaagactgagccaaagaagatgggacaagccacccaaactcagggtcgagatgaaaatcactggaaatatgagataaacaatgattcgccagtgttttaaaatagccgtaatatctgcttcctccgactctcggaaaagcaagggcccgataaccagtgccaaaaacaactccgtattgaggtgaaagtcggtattgggtaaaaaaagaccaatcacgattcccaaaagaatctgcaccaaagggagaggcaaaaagggcaggagcttattggttgtacttgagacaatcaagaccagtaaaaataggataaggtaaatcagtaattccacggacttcctccttaattttttttacaacaggattcaaatatctccttctgctctttgattttttgatcaatcttggaacaatccttgtgctcaatttttctctggcaccgttccatctcaagagcaactaattttttcttgattttaagcatttttttgctcatgtgtgcttggtctaacacacccaccgctcgttcgtgttgggttgattcaacaaaattctggcgcatggcatccagcttttcacgtaggtattgtttatccatgtctatatctctctaatttttcaatcatcactaaaaacggtgggttgttgacttggttcagggttcggtaaatggcagctgtgtactcttgttggttcaactggctgacaaaatccaagacagcatccctctctaggtcgcctcctttatgaccataatagatcatgatagcaatccgtccacctttgacaagcaaatgacacagcttttctaatgcttcaatcgttgtctgaggttgggtaatgactgacttatcagctgatggcaaatagcccagattaaaaatccctgccttggcttctgtcacaaactggtccagtgtctcgtgaccttgcaagattaactgggcatttgtcattccagcttggtccaaacgctcttgggtcttttccaaggcttgctcctgaatatcaaaggcatagacttgcttagctagtttcgctaaaaaaatcgtgtcatgaccattacccatggtcgcatccactacgatatcctcttttgtcactacctcagccaaaaaatcatgtgccatctcaagtggtcttttcattttcaaactcctgttttacagccttgcatccttgaatacttccacgacgtcgcatctccatctcaatgctgttgagcacttcccacttattgaggctccacataggcccaatcagcatatctctaggtgcatctcctgtgattcgatggatgacgatatgcttgggaatgatttccagttggtcacagatgaccttgacatattcgtcctgactcatcagttgcaaacgtccctcgtggtagtcccgttgcatacgagtattggtcatcaggtgaagcaagtgcagtttaatcccttgaatatcgttatccgtgacacaacggcggacattttcaatcatcatctcatgggtttcaccaggaagtccgttgatcaaatgagaaacaatctcaatcttgggatattttctcaaacgcttgaccgtctccacatacaactcataggagtgggcacggttaatcaggtcagaggttgtttcataagtggtctgcaagcccaattcaaccgtcacatgcatgcgctccgataattcagccaaatattcgatggtttcgtctggtaaacagtctgggcgcgttccaatattgattcccaccacacctggctcgttgatagcctgctcatagcgctctcgaatgacttccaccttttcatgggtgttggtaaaattttgaaaataaaccagatacttctgcacatctggccacttgcggtgcataaagtcaatttccttataaaattgctctcggataggcgcatccggtgctacgatagcatctccagaacctgaaaccgtacaaaaagtacagcctccatgagccacagttccatcacgattgggacagtcaaatcccgcatcaatcgggactttaaaggtcttttctccaaagagttttcgataataatcattcaaggtgttataagatttcataactttcattataacaaaaaacatctacaatctcaaaagcctgactttcctataaattcctctgtttctcgtttccattagcgattttttatgatacaatatgggtatgattttaatgaaattagcatctattttattattgatactgaccctagtagtctgcattatcataaccaaactttttagattaaaaaaactaggacgaaactttgcggatttggcttttccagtcttggtatttgaatattaccttattacagctaaaacctttacccataatttcctccctagactgggcctagccctctcactcttagccattattctcgtctttttcttccttctgaaaaaacgcagtttttactatcctaaattcatcaaattcttctggcgtgcaggattcttattaacccttgtcatgtatatcgagatgattgttgaattgatggccctctagctgaatcttatatgagacataaaaaataaaggatttaacccttttgacttgggtaaatccttttttcttgtttaaaaatcgtttgagcagagcgtttccaagcgagacttcacttgtctcgcttgggaacactgcacagaataaatcttatgagaaagttacattcctcaaatcaatcttatccgatccactcaccgttttcatttacttgataaccatccggagttactgtattgacagcaagggatccatttgcatcaacataataccatttgtctccaacttggaaccattgacttgtcttcatcgaacctgatgcatcaacatagtaccacttaccatcttgatccaaaatccactcattagatgacattgcacctgattgattcaagtaataccatgcacctgattgatctttaatccagccagtttccatttttcctgtttgatcaaagtaataccaagtatctccatctttgacccaacccttagccaagtccccattttgttgacgataataccatttaccatcttccttgttccatccaggttttttgctttcctgagtaggagcttgtatcacaatgttcggagcaactgatagatgatttttaaaatctgaactgttacttgtcacaccattatttgatggatttggaatgacaatatttggattcggatttgctcctggtttttgttccgtaggttgactgctaccattgtcttgatgtccacccgccggcgtctcaatgttacttgttttcttcttagtacctaccaacagaattctatttacaggttcttccagaatctcacgtgatttttctttattcttgccatcagtcgttacttctgtatagatacgttccttaccaactttaccttcttgcaacaggcgaacttctccctcaaacagagtatcgtctttttgttcaagagtttggaagttcaattctttgtctaccacttcaagactaggcaagtcatattgagcaggagctacaagttttgcgtctatcactttttccttagtcaatttaatccggtattctttgacattcttaccactctctgataccagacggactaatacaggaagattttcatttccactatccacaattgtagatgtgacttgatctttcccttctacagtgatttttggacgttcccctttataaatcaattcatagtccaaacgattttcagagaagtcaggaagctctttaccatctactaaaattcttccctctgtgctctcttttgcaagctcacttggtgctcggaaacttaattcagttagtgcaaccccatttttatctgcttttctgtccatacgccatctcatagctttggtagtcacagctttaaaggtcacattgatctcatttccagcttgaatttctttgtctgcgtaataaggaacaagttcccaattatcagggttattaaatggatgatttgattcgtagctgtagtttgaatagtaaaccggaacatcaaagtcaggaccgatgtatcgttccaatacgagtttagctggggcatctgttccactatctgcaaagaagtttagtttagcttgtgaaacctttctatccacaattttaccattctttttaaagataacaccaactgatacttctggattagcagatggagtagcggaccagtttgtccaacggttgtcttgatttcggtcattatcatttaaatagtctacacggtcgttcgaattatcatccaaatcattagtagctgaagcaaaagcctgactatgagtagcaagataatctggattatcagaaagtgatctaccgaccttgtccgttactcgaacagataattctactgggacctcactaccaactacatggcctttaattgtatattccccagctttgtttaaggtagaagcagggactttttcccattcaactgccaaatcttttacgtcataaccgctcttacctgcgaaataaactggaaccttatttggcaattccaaaggttgacctaactgcaacaattgagactgttttgcagaagcaattggtttacgagccaacaaatctttatcttttgtaaagtgaaggttgtattctccaagaatatcgccattttctgctttcacaataacacggacaggatcgccctctttcacgctaggaaccactgtagcaagtccattatttgtgatactagctgttacttctggaatttttccatcactatagtctaaatagtaatctgttaagtctggattaaagtgaggaagatcttttccagcaaccttaatgttagtagttgcctctttagctggtgctacctttttagagaaaacttgtaattctgtaatggatgttccaagtttatcatcagctcttgtcatgcgaatacgtaccgcgtaggtatccaccttatcaaaactgaaatgattcatttctccagcttttaactgatctggagccttaagatttgtgactggtttccaatttttactgtcattaaatacgtggttttcaccctctacataaccaggattcttcggtgcagttggagctttttcaccaacataatactcaatgacgtaagattttggagcacctacaccgctatcttcataaaatgctacattcaagttatcgaccgaacgttttgtcaaaatacctgaatctccaaagagtacccctactgaagcttcttcagaacgtttccagtttgaccaacgatttgcaggctgatcaccgtaagaaatcactttatcatttacattagatactgggtcataagaatgagaatctgatgcaaaggcaagtggtaattctgaacctgtccattgatctgaaatattcttcccaatttctgtttgactcgatacacgaacatgtaatttcgttgtcagttgtgttccttctacatggcctgttacagtaaagattccttcttttgcatactggcttgcatcaatagtgtcccaagccaccttagctgaagatacttggccatttgaataataagttcggacactttctggcaaggttggtgcctcagaaattggtgttgtgatgctcacatcttcaacttttacaattccttctactgatactgtcgcacgagcttcttgattcaatccttcaaccttaccaagtacttcaaaagtatgatattgatttaatttttcagatggaatcgaatcccaaactaccttatgaacttttggaaatcctttatcgtactcaactgttactgtagatggaagatttggtgtttggtgcaaatctgtcacaaggctaactgggcgaatggcctgaacaactttatcttcagtatttgctgcgatcgttagaggaagttctccttttgcaccttcatattgagcttgtaaagtgagactacccggtttatgcaactctagcattcccttattaacagagactcctccctcgccttggcttgagaaagtcaccttatcagttggtaaaatagcttcagttccatcctgataacgggctaaaactgtcactttaacagtttgatcttctttgaggctagatacttgatccactctgagactcaagctttcaatttgtggagaatcaacaaggaactgaacagcataggtttgtaactgtcccccgtctttaggctgaatgtagatactagcacgcattccattggattcatttgcctgaatcacgttcacatcggcattttcagcactagcactgacttctggaatttttgctccataagaaagtttgtgataatgtacaggatgctcttttgaaagttccgtaacactttcaccacctactgctatatttggtgtaacttgagacaattccttaccatcatcaactatcaaagtagcgtggatggttctatctcctaattggctagtcatctgaatatgtgcccccggagtagataacttctctttatcttctggtgaaatttcccaattttcaacttcataattgtgaatacgaccatctgttgaaacaagtgaaacaagtttatccacagaactcaagtctgttccaggtgtgatgcgtttaacagctggaagttcattcgcaactgtaagtacttcaacacgagcctcaacttcacgtccatcagacataccttttacagttacaattccagcttgactgacatctgcttgagaccaggttacaggacgtttttcacgactaccatcactatatacaaatggcactgtctgaggcattttaagtttttgtcctaaaactgtccgaacttttggtatttctgttcctaaaacagttttttctgactggtctgacttacctgtaaaaactgtaacttgatctgatttcaacaagcctgaatatgctgtaagggtaaatttacctgcttgatcagtcgatttaacaatcgctacccctttaccattaaaggctctacgaatccaagaaccatctgcttgttctttataacgttcacgactagcttgctcaccattatccacaccaaccagttgaccttgtccatgaagttggaagtgaactagattgttagcagttggcacaacattacccttgctatctacaatttcgtaatagatataagtcaaatcttttccatctgcagcgattgcattttcttccttaaccaaacggacacctgcaggttcaccagcagttacaatcttatcacgagcaatttccttgccagactcatctcgagctacagcttccaaagttcccggtttataagctactttccactccaagtatagttcttgaggattttcaccttcttgatatgttcgaccgtcacttgtttgttttttgttgaattttttaagacctagtgactcattatttaagaacaactcaacactggcagcattggaataagctctaactggaattcgattttcagcgtctgcaacattatctgccaattcagtcttttcccagttccagtgaggaagtaaatgaaccattggttttttcttggcagaaacccactgactttggtagagataatagtcattttttggaatacctgcggtatcaacaataccaaagtaggaactttttactggtgtactattttgattgtgccatggtgttggttcaccaatataatccgtaccggtccaaatgaattgtccagcgtatcctggatgatctctatcgaaggtccatgatgctgtagcagttttaccccaaccaacacgatcattaccataatcggattgttcgtaattacgccaatattggttacttcctacccactcactctctggatggaaataacttcctcttgtacgagttgctgaagatgtttctgaaccatagatgagccatttcggatgtttcgcatgaagagtttgataattttcttcagagtaattcaatccaactgcatccagttcatctgcaatcttttcatggtccccagttccatctccgaaacggaatttatcagctcccatggttacataacgtgtcttatcaacagatttcaccactttgaccaaacgtttgacagttaccagtgaatgggctttcccatctgcttcaccgatttcgttaccaatagaccacataacaacagcaggattgtttttatctctttctaccattgttcgaagatcgtagtcggaccatttttcaccttttcttgcttcagggtgggtagcatctttttcaaagaaacgaccatagtcgtatggtttcttacctccataccaagtatcaaaagcttcttcttgaacaagcaaaccgagctcagctgcaatctgcaaggtctgaggacttgctgggttgtgagtcgtacgaatcgaattcactcccatttccttcatttgtttcagacgacgatattctgccttatagttttcttctgctcctagcgctccatgatcatggtgcaatgaaacaccgtggaacttgatgtgttcaccatttaaagagaacccttggtctggagtccagttatagtagcgataaccaaataaatctttctttgcatctacaagctgaccatctttgtaaacacgagttaccatctcatataaagcaggtttgtcagatgacactgtccacaattttggtttttcaacctctaatgctgaatccaaatgaatggtttccttagcttttagagttttactctcagttcgaacaagttctgtaactgccttaccacctcgttcaaaaatttgatactctgctacaatttcatggtctttattatctgtattaacaattttactgcttacttgggtttcaacttttcctccttgttgactttctagttttggagttagaatagttgtcccattcttttcaacatgaatcttgtctgttacctgcaatgatacgtctcgatagataccacttcctgaataccatctactacttggttgcttattaactgcatgaacagaaatgacattttctcgcccatctttatggagatagttactaatgtcatatgaaaattgattgtaaccatttggatagtgaccaactagttggccattgacgaatacttgtgaatccatgtaaacaccatcaaaggttacacgaacatctttattcaagtccttttcatctaacttaaaggttttccgataccagccatctccaccattcaattgaccgccttcgttttgagctggtgaatcatggtcaaaatcaaaatgaatactccagtcatgaggaagatccatttttttccatgaagaaatatctgcgtctggttttacagcttcctttgcattggcatttagtttaaagtgccaattctggttgaaggaaatgtttctatcttcaattaacttatcaactacttcattcgtagcagatttgaattcttgcttatcttttgaaacagaacgatcttgtgattctgctttatttgtttcttcagatttatttttatcttcagatttatccgttacctcagtcttatttgtttcttcaagcttatttctatcctcaggcttgttcctttcttctgttttgttttcgacttcagccttaccttcttctaaaggaactgattgattattggcaactgaaactaaaggttgatctgcgtgaggttttactactgcatcactaccatccgcattttcctttagagatacattttcagctttaacaggttgctcacttgctttttcagtcgtaacaccttcagctttatgttcacttgagagtccagtagttttcaggttttcagactggtgctcagtcctatttgttaacacaatttcttcagcattttcgttggcatataccgaagaagatagactaacgcctgcccctaataatagagcacatgtccctataagcaccgagcaagcaccgactgaaaattttcgaatactatacactctttttttgttccaattacctttttgcatgtaatcctccttttggtaaccgctttcattttatctgagagcaatctacttattataattatcttataatacgattttataaccaataaaaaatttgtcaatcgaatacagataaaaacaatgttttggaatgttttttataaaaattggagagtttttaaaaagtattgaagtagaatttattataataaaaatgatttccgactttctttaaaattttaagacggaatagttttttattatcccaaacagaaaaaatctttcttaaagatttaaacatacaaaaagagcaaacgaatatttcagtttttttctgatttcgttaactcttaattcttagtttgatttattaatattggttaaatttatcctattcctagacgttaatatccagatttatcatttcacatcgctatttgaaaaatcttattttccttctttatcaggaaagataaatccaataccaatgcaagccagcactcccgctccaattaccaagctacttgaaattggtaaaaggtccaaaattgcattcgcaatgataaaggcaataatcaaacacatcaaactagccttgtagtcctttttcaaaagattctctagtgtgaaaaagaggaacaagcctaccggaatgagtgaccagaggttgacatccaaacttggccatccaacagaaccaaaatacactactgtcgctgctgctactaaaaatacaattcccaataattttttcatttttatctccaatttcttttttaggaacttgagttatctgatatcgatccttcatgtcccttacaaaaatcattatagcagagtcagtttcaagaacaagtgcttttgcctatctggtctctatctcggtctaaatggttcaataattaaaaaaaagaaacccagtagaatgagtttcttcactttgccgattgcagggtttgaacctgtgacctaggctttacgagtgccttgctctgccaactgatactcaatgaaaatcaaaaagcaaactaggaaactagccgcaggctgtacttgagtacggcaaggcgacgttgacgtggtttgaatttgattttcgaagagtatgagctaaatcggctattacacttaaagtatagcactctaagaataggtgtcaagaatttttcatctctattagaaaaagcctgtcctgagacaaggctttggtattctattatttacgaacctgcactttcgtaggcatccaagcccctatcccaaagtttaagggaaatgacaaagaaaaccagagaaatcaacatcaaacctccgatgttaaagattacatccttgtcctgcaagaaatagctggcaggatagtaggccgtaaaggcaaatggcacgataaagctaatcaaccatcgaaggactgaattgtaaatggaaatgggatacttggcaaaatcattaaacatataaaaaatgtaaatcattgctcctgactgcttggtccaaaaagcgatgctggctgtcgctatcttcaaggaagtataaatcaaggtcgcaaaaggaatgcagactaggaaaagtaggaattttggaagagtccaagcaatgctagataccgttgtcgctagtaggatcccaccaaccaagagttctcccaaggcatcaatctgaaaagtctcaactagaatatgaaagagaggattgataggacgtgtcaaatacttgtcaaactccccttttcgcaccaagcgttgtcccagtgcccagagattgtcaaaaaagagatggtccagtcccttgggaaccaaggaaaatccatagataaaagcaatttcttgaaaagtccaaccttctagggatgggatgtgttgaaagatgacattgagaaacaagaggttcaagccttgggtcagaaaaactcccagaacaccaactacaaaatccaccttgtattccatgatttgcttgatgtattgtctgataaaaatcagatgcatgcgttgatattttttcatactaacctccctgaatggtaatgaatgactggactcgtttccaaatcaactgagacaagcccaccatcactaagagccagaaaaactgcaaagcgagcgcctgaagaatctgattggcatcgtatttcccaacgataatcatgaccggagtgtaaatcaaggatgaaaaaggcagaaaggacaaaatatctgataccaccttgggaaagaaagccaagggaatcaaacttccagacataaaggccactattgaagtcttaagtaggttggaaccccaaagatttttaaacacaaaggcagaaaatccaaagcagatattaaagaaaaagttaatcagataggccagcgttaagctaaaaagataaaggacagttaatcccagcacttctacaatcccttgcccagatacgattttcatcaaaacaatgacacttaaaaatggaaggccaacagagataaaaatcaaccacttggagccaagctctgtaaaaaggtaagatgccgcaaaatgcactggtctcaacaagcgcatgataatggagccatccttgacctcctccccaatcataaaggagctatcagatctggtcaaaagattggtcacaaaactcataatgatgtagagggtgatatctgccatactaaagccctgaatcaaggactcttgcgaagaatcaaagacagccttccagagataaaaggccacaaaagcacccatgacatcgccgatccgataaagaataaagttgactcgataggtaatcaactcctgaacgcctgcattgataaagggtttataacgtctccacaatttgaccatcttagagctcctttcgatagaagcggcggataatatcttcaatatccgtatccatcatcttcaaatctcggacctcaaaatcagacagggtttgcttgataatgtcagctgactggtagcgggaactatcgaattcaatgttgagactattcccttgtctatcaattgtcatatccgaaaagccttcatagtgagaaaggagatgactttgacctggtagcagttcaaaagaaagagtcttcatctttccaaaggtttccttgagttggctcaccgttccatcaaaaatctcctgccctttgtctatcataaaaatccgatcacagagttgctcaatgtcgctcaggtcgtgagtggtcaagagaatggtggtttcttcctcctgattgatctgagtaatagcccgacgaatgttgtccttgaccgaaacgtccaagccaatggtcggctcatctaaaaagagaactttaggattgtgaagcaaggaagctgcaatatccgcccgcatccgttgtcccagcgaaagagttctcacgggatccttgataaagtccttcaaatccaagacttcattcaaaaagtccatacgcttatgaaagagcgagtctggcacatcgtaaatctcttttaaaaccgtgtaggtctcttgcagggccaaatcccaccatagctgggtgcgttgtccaaaaacaaccccaatatccttgacataatcttgacgattgtcctggggaatcttgccgttaatccgacaaaaaccagatgtcggttttaaaatccctgtcagcattttaatggttgtcgacttcccagcaccattagccccgataaatcctaaaatttgtccttttgggacctcaaaggtcaaatccttgaccgcttcaaaggtctgcttttcaggatgaataaaggagcgcaaagcccccttcaagcccggttccttaacagtcttcacaaaatttttctgaagatgttccacttctatcattgccatatctatctccctatgtaaggaatagcacttgttttttgactacaaatattctaaatccttactttctacaccttctcaatattattacagaagtctttacaccaatctattatagtccaataaaaactagaatgcaagcgtttgcttaaagtttatgaaatttgagatttctctcttaaagtgatatttttagtccaaaattctgatttaatagtctccttaaaacaccaaaaaacccacccaatgggtaggtttcatctgtattattcagctagattaagctttaccttctgaaccgaatacgtcgatacgttcttcaactgatgcttggatagcttttacaccgtcagccaagaatttacgtgggtcgaagagttttttcttgtcgtattctgcttcgtttgcttcgtagtcacgagcaaatttacgagttgcgttagcgaatgcgatttggcattcagtgttaacgttaactttcgcaacaccaagtttgatagctgcttggatttgctcatcaggaatacctgatccaccgtgcaatacgattgggaatcctggaacagcttcagtcaatttttgcaagtgatcaaggtgaagacctttccagtttgctgggtaaggaccgtggatgttaccgataccagctgccaagaagtcgataccagtttcaaccattgctttagcgtcttcgattggagccaattcaccatcaccgatgattccgtcttcttcaccaccgatagtaccaacttcagcttccactgatacaccatttgcatgagcaaattctacaactttacgagctttatcaaggttttcttcaactggaaggtgtgaaccgtcaaacataactgaagtataaccaactcggatacactcaagtgcatcttcgtagtgaccgtggtcaaggtggatagctactggtacagtgatacccattgattcaacaaggttagcgatcaagttgcgagcaactttgtaaccacccatgtatttagcagcacccattgaagtttggatcaaaactggagcttttttagcttctgctgcgcgcaagatagcttgagtccactcaaggttgtttgtgttaaatccaccaactgcataaccgttgtcacgagctgcttggacaaatttttgtgctgaaacgattgccattttatcaggcctcctgtatagttttatgggtcatcccatttacattgttcattttatcactttttgacaaaaaaatctagtttttcccgcagtttcgattgaatttcttctagcttcatctatgtaaaccctttctctccctagtcttaggcgattcttggaaaagctatgaagaaggtcaaacgattctccttcatctcaaaacgataaggtaatttttcatgttccaatagactcttgaccacaaagagccccatcccagaacccttggccttgcgactagcattatcagaaaaagactgagccagtttttcttgttcttcaggactacagctattctcgataaaaagttccccttctctctctccgatgcggaccaagccgcctggaatggagtgcttgatagcattgctgatgagattagacaggattaatttcatcacagatggatttagataagcctgctggtggttcaaactattgtcaatctgaagttctctctcctttgctagcaaagaataatcttgaactagactttgcgtcatctggaggagatctattatttccctatcatctcgcaattcctgcacagaagagagagaaagtatctggagaacgtggtgattgagctcatccacaattcctaaggctactcccagatagcggtctctatccttataacgaccgatattttctttcatgttttcaatcaggattttcaaactagctaagggtgttttcagttcatgggaagcccctcgtaggaattcgaccttcatcttttccagctggagaatagcttcattcttgtcatgcaagtccgcaatgacagtcaaaagatgctggtagaggctattgatttgttccttgagatcaccaatctcatccctagaatccacgtgcaatcgcacttgggcatccagttccatcattctacgagttactcgcttgatttccaaaatcggggcaacaatggtccgagcatagatataggctaccaaaagggaaatcagaaaggatgccagcaaggtatagggaagaaactggagactgatttgctctgcttccttttgcaaatccatggacgctaaaaactggagagtcatggtaccaccgtcctgcgttttcacctcgcgctcctcgataaaaagagaggttgtctggcgatctgtatccagaggaaggctgtcctttacttctaacttgtcctcggtcatctcgcccttgacggtccccttgatatcactagtctgagaatacaagtctaagacttgctcgatattctgcctatccttaccttctagggactgggcaatggctgtcgctttctgaccaatggtttcctgacgatgactcagataagtcgaaggaaaaagaaaataaatagccaaatgaaggcagataaccagaacactaaatatcgagaaggtatagataaatatctttgtaaataaacctgttcgtttcattttcgctccaatttataaccaacattgcgcacagtgaggatgcaatccaagtctagctttttccgcagttccttgatataaacatcaatgacacggtcaaagggaacctcatctgtcgctttccatacggcatcaataatctgagatcgtgtcaaggcccttccttcatttttaaccaaataatcaagaatttccaactctttagcattaacagccacttcctctcctgctaggcttgcactgtagctttcaaagtccaccttggtatccttataagagaagattcgtcccgtatcataatagcgcttgaaaatcgcgtccacccttacttttaagagggatagagaaaaaggtttttccagatagccatctgccagagaggcaaaggcactcatcttgtattcctcatcctgaaaggctgttaacatcaagacagggacttggctggttttgcgaatctcagctagcacttccagaccattgagcttaggcatctggatatccagtaaaaccaaggctacttcatagctggaaaatttttctaaagcttcttgcccatctgcagcctcaatggtttcataaccacaatccgtcaaataatcactgatcccctcacggatcatctcttcatcttctacaattaaaattttcatagaaaaaacgtttcacattcctttaaatttcttgtaaatcatctcaagttcatcctgaaagaaagaggccttatcaagataaaatagataaaaatgctacctatattataccccatttagaggagattaggtagcaagtttgttattcgctatccagcagaagctcttttggttgttttctaaggagattgcttgaagcaaacgccataacgagaaccactagaaccaaggcaaggacaaagacgatgataaagtctgatgtctgaatggaaatatctaggctcgacaaggtcttactaaagccatctacttctgcaccaccaccaaggttagaggcttgagcagccttgctagcttgcttggcaacacctgaagtgacattggtaagaacagtatttccgattgcacgcgctgtgtaagtagctaagaagtatgcagaaacaagagcagggatggcaatcaagatggattcagtgatgaattgacccaagatacttgcctgcttgagaccgatagagaggagaatacccacttccttgcgacgggcattgatccaaaggctgagtaagagggcaaggagaagaactgagaagctcaagctaccccagaagaggagattggccatcttgtacataccagaaatggattgctcaagagctgggtagttagaggagctcttaactaaagtatagctcttccagttgataccactgatgccattcaactctttcataacatcatccaagttcttgtccgctgttacaaagaaggttgcgtccccataaatagctgtgtcttctgtgtatccataaagttttgcagcagtgtgaatgtctgtgatagctgtattttcatagagttcttgtgagtaggttactgccgatttattgtgaccatcaaagagtcccttgattgtcacttcgactgtttccttggctcctttttcattgtctgcatcgtagatattagagtctagtttgaccttgtctcctactttccagccgtgtttggctgccaagtccttgtgcaggaggatcttgtccttgtcgtcgtttgttaggtgttcaccttcgaccagcttataagaaccagagacaaacttgtcttctttagaggagtcattgacacctgtaatcatcaagctacttccaaaatgtttagcacggtcaggtgtcagatttttcttagtttctggcgtttcgatgagttcatagccagtcaaatctccgatagcgttgatgcgtttcacataagactcaatggccttgttttcggtgatttttttgatatcttcacccttgatattcccagcaccacgtggcgttccttgattgacgcgacgattgatttgcatggagaagctgttggtgatatttttaaaggtctcctgagaagccttggcagtagctcccttgattgacaagccaaccaaactcaagctcgccatgaggagaataatcaggaagatgacaatcgatttgaaaaacttccttgtaacataggcaaatgcgttgtgtaacatagattccctttctagaatttgttctattttatagttctaacagaaaaagctcatattatttcgtcgtattgcgagtttcagtcagtttcttatctttcaactcaagtgtaatatctgatgcttgcgccacttctttgctgtgagttacgacgatgacacatttacctgttttctgggcaagtgatttgagcagttcgacaatatctccagcagttttagggtccagatttcccgttggctcatctgctagaataactggagcttctgagaccaaactacgagcaatggcaacacgttgttgttgaccacctgataactggagaacattccgcttgatctgactttcatccaaaccaagctcaagcagtgtatccttgctggcctttttgttgaccaagcggatattttccagtggagaaagataatctatcaagttataattttgaaagaccagggaaatatggtgcatgcgatggtaagaatagcccttcttacgaatatcctctccttgaaaaaggatagaaccttcaacaggactatctagaccagcaagtagggacaagagtgtggattttcctgctcctgactcaccaataatactgtaaaatttcccgggttcaaaattataattgatctgatataggactgcttcagcagtgttcttataacggtaggtaacatcttgtaattgtaataaagtcatgatttctccttcttaactaatagatgataaaatttctttcggcgattttctaaataagaataggaaacaaagggctacagataagcaactaatcaacaacagaaagacataggactctgcaaaagataataaactacttgatagaccacttgttttggctagtgtattttgtaagcttgcctgatctccacttgctagtagagtttggagtaggtaggatgtgattgcgtttcctgtagcaaatgctggaagcaaagctccgagagataccaaaaatacctctaaacagaactgcaggaaaatcgaactcttgccttttccaagtgccagaagaatccccacttcgtagacccgttctctcaaccagagagacaaaacaagaattaaggctcctgctcctgctatcataatcccataaaggaaaatggtcagaaaggtttggaaagttgcaaccgagtctttgatttgttcaaaagccttgttttccttttcaacttgatacccttgattttccaaggccaagttttctacctgcttcatgagtccgtccatttccttaggattttctacataaaagcgcgctgcactgactagagattcaccatttcccaaaaggctttggctactttcatagtctgtaaagacttggttttcactgaagtcagaagacaagcctgtaaatttctcttgttttttaccagaaaagatgccgacaatctcaaactccactgtttgccctttgccagcttctgactgaccagcatctaaggcaatcttgtcatgaagggaaagactattcttcttagccaactcttcgtggatgatgattttctttgaatcccctttttgaagatgtcgcccttcttttaagttgaaagccgagctggtaaaggtgacatccttagatgaatcttcaagagctgttaagctaaccaaattcttatccgcagcggacaaatcatcacgttccacgctctgctcgccactcactgcttccttgtcttttagttttgcgaccgtctcgagttcaggagaaacattttccagtcccttaatcttgcttacagatgctaggtctgacaacttgaatgtctgaccattttctatcttcttaatagaaaaagaggtattgagtgatttgtaaagattggtttcaactgttttgttggacttcatcagagtcaaacaggctgaaattccagccaataggaccaataaaatcagaaataaaataaaacttctcagtcgttttctgctgacataagcccaagctctttggatcggattcatttgtcacctccatatttgtaagactattataaaatccaaatatgaaatgtttatgaaatacaaaaaagagcaaaatttttttgctctacttgaattatatgaaaacaaaagagctagcctaagctaactcttatcctatgcggagagagggacttgaaccctcacgacctaaagcggtcacaggatccttagtcctgcgcgtctgccaattccgccatccccgcgtcgattactttactagtatatcaacttttaggatgcttgtcaacactttttttcaatttttttcatttcatcaaccaaattactctgaaaattcatttagattttcatctactaacttagctccgagtgtatttttgaaatgacctagggcaaattgatgattttcaggccagatagatgcaacagccggtttaacaatctcgatgtcatatcctagattataggcatctatagctgtatgcaggacacagatatccgtcaaaactccggttaaaataactgtagaaattcgacgctctctcaaacggatatctaggtcagtacccgaaaaagctgagtaatgacgtttatccatccaaaagacacgactgtctgaaccatgctcttgataaaagacccccaaatctccgtataaattccgtccactagtcccaatcaaattgtgaggaggaaacagcttgctttctggatggaaacaatcgttttcttcgtgagcatcaatggtaaagaagatgtaatctcctcgttcaaaagctagtcgagttaccttgctgatggcatccgaaatcgcctgagctggagcgcctgctgtcaattttccactatcagcaacaaaatcttctgtataatcaatcgaaatcaaagccttagtcattagtaatctcttttcttcacttcttcaaaaatatctgaaatcaaaaccttaaggtaggttcccttcattccaagtgagcgactttcaataatccctgcagactcaagtttacgaagggcattgacaatcacagaacgagtgattccgatacggtctgcaatcacagacgcagtcaactgcccttcatttccatttaattcccctaaaattgctgaaacagcacggagttcggagtaagaaagggtattaaccgccatggtaacagcagtacggcgacggatatttttctcatcttcttcacgctggaaattaaggagttgaattccaacaacggtactcgcaatctcaacaagaatcaagtcctcgtcttcgaattttttatcattgcgccaaataatcaaagaaccaagtcgaatccctgatacatgaatcggtgcaatagtcgtcaaaccatctggaaagtcggcacgactttccacaggaaaaatgcttaaatcatgatcaactgtcagattggcttctgtatcgtaaatcatgttcgcaccttgaatgtagtcatctgggaaaatcttagtttggaagaactgctctacacgatctgtattggttttgtaacgcataaaataaccaaggagacgtcccttgctattgacgatacaggcgttacagtcaataatatctgccaattgacgggtaatcgcattgtagggaagttcttcctgcaactgctcctctgagcgcttcaggatagaagtaatttttctagttttttctaataaatgtgccatttttcacctcgaatttaatcgctatcattataacataaacagcttgaattttcaattattatctgaaaattgcttatttaattgcaatttgaaaaaacaagaatatttttaattaaattgcttcttttctattgacaagccccttatttttgtgtattataatattacaagaagataatatatctattttatttatctttctttttccattcggtctccttatataaaaaagcgattcgttttgaaccgctttttcttatttatcgcccttgttacgaataacaaagcctgtttgcttttcacttgaagtattgcgtggttttttattatccttacgataacgtttttccttatcataacgatcatttccacgactgccgtttttgaaatcatcacggcgaccattgccacggcgttcgcgatcacgacggtcatctccacgacgacctcccttacctttaccaccgaagccattacctgatggtttaaatggcagtggtttttcacgcgcaatctccacttcaggaaggctatctggatcttggacagtcagactcaagatatacatggccaattcttctggagtaaattcagcagccaacttgcgagcatccttaccaaatttctcaaagttgccacggattgtctcatctgcaaaatcacgttcgattttcttgagtgcaacctgtttcttagcttggaaggcttcttctgcacttgcaggtttaagacctttcatgcgcttcttagtcaagttttcaataatttgaaggtaacccatttcgtttggagcaacaaaggtaatcgattgacctgatttaccagcacgacctgtacgaccgatacggtgaacataactttcaggatcttgtggaatatcgtaattatagacatgagttacacctgaaatatccaaaccacgcgctgccacgtctgttgcaaccaaaacatctagattgccgtttttgaagtcacgaaggacacgaagacgtttgttttggtctaggtctccatgaattccttctgcacggaagccacggattttcaaaccacgagtcaattcatctacacgacgtttggtacgaccaaatacgatagcaagttctggttgttccacatccataagacgagtcatggtatcaaatttttcttgttctttaacacgaatatagtattggtcaaccaattctgttgtcaattccttagcagcaatcttcacatgctcaggttctttcataaactgaacaccaatacgtttgatggcatctggcatagttgctgagaaaagtaaggtttgacggttttcagggacacgagaaatgatagcttcgatatcttcaaggaagcccatgttgagcatttcatccgcttcgtcaaggataagagtttcaatatcttgtaatttcaaggccttgcgtttaatcaagtccaagaggcgacctggagttcccaccacgatatgggcaccagatttaagagccttaatctgtttttcaatgcttgatccgccatatactgagcgtactttgactcccttactacgaccaaatcggaagagttcttcttgactttggacagctaattcacgagttggagcgataaccaaagcttggatggtcgcttcttctgtacggattttttcaagggttggcaagccaaaggctgcagtttttcctgtaccagtctgagcttgaccgataacgtccttgccttcaagggccaagggaatagtttgttcttggataggactggcttctacaaaaccagctttttcaatctctgctagcaaatcagcagacaagtttaattcattaaatttcacgttattcttctttctaaaggtggtgcgaagccaccctataggacttagtttatacttttctttttatgacgtattttcatatactggatataaaatcgtgttgcttcttttccacaaaagaaaagtactgttttctttgcaacctatctagtataacacaagagagaagcaaaagatagcccaatccatcgataaagtcatgtaaacgatttttctgagaaaataaagttaaactttccactatttcataaacttttttaaagcgtagcagaattgtgcaaaagtttttttcttgtgctagaatgaaattcgaataggaggaactctaaatgttaacttatgatttaatcgttatcggatttggtaaagctggtaaaacactagctggtaaattggcttcagctggcaaaaaagttgccctcattgaacgtagcaaagctatgtacggtggaacttgtatcaacatcggttgtatcccaactaaaactttgctggttgctgctgagaaagacttgtcttttgaagaagtgattgctaccaaaaacactatcactagtcgcctcaacggtaaaaactatgcgactgttgctggtacaggcgtcgatatctttgatgcggaagctcacttcctttcaaataaagtcatcgaaatccaagctggtgatgaaaagaaagaactgactgctgaaacaatcgtcatcaacactggtgctgtttcaaacgtcttgccaatccctggacttgctacaagcaaaaacgtctttgactcaacaggtatccaaaacttggacaaattacctgaaaaccttggagtccttggtggtggaaatatcggtcttgaatttgccggcctatacaacaaacttggaagcaaggttacagtcctagatgccttggatactttccttcctcgtgcagaaccttccatcgcagctcttgctaaacaatacatggaagaagacggtattgaattgcttcaaaatatccgtactactgaaatcaaaaacgacggtgaccaagtgctcgttgtgactgaaaacgaaacttaccgtttcgatgcccttctctacgcaacaggacgtaaaccaaacgtagaaccacttcaacttgaaaatacagatattgaactaactgaacgtggtgctattaaagtagacaaacattgtcaaacaaacgttcctggtgtctttgcagttggagatgtcaacggtggccttcaatttacttacatttcacttgatgacttccgtgttgtttacagctaccttgctggagatggcagctacacacttgaagaccgtctcaatgtaccaaatactatgttcatcacacctgcactttcacaagttggtttgactgaaagccaagcagctgatttgaaacttccatacgcagtgaaagaaatccctgttgcagcaatgcctcgtggtcacgtaaacggagaccttcgcggagctttcaaagctgttgttaatactgaaacaaaagaaattcttggagcaagcatcttctcagaaggttctcaagaaatcatcaacatcattactgttgctatggacaacaagattccttacacttacttcacaaaacaaattttcactcacccaaccttggctgagaacttgaatgacttgtttgcgatttaagttgagatttaatcgtatcgaacatccctctttgggctgtttttacttctgcggaacctcaaatctgtcttttccttcttttatgatataatagaaacatgaaattaaaaactactttgggccttcttgctgggcgttcttcccacttcgttttaagccgtcttggccgtggaagtacgctcccaggaaaacttgcccttcaatttgataaagatattttacaaaacctagctaagaactacgagattgtcgtggtcactggaaccaacggaaaaaccttgacaactgccctcactgtcggcattttaaaagaagtttatggtcaagttctgaccaacccaagcggtgccaacatgattacaggaattgcgacaaccttcttaacagccaaatcttctaaaactgggaaaaatattgccgtcctagagattgacgaagcaagtctatctcgtatctgtgactatatccagccaagcttatttgttatcactaatatcttccgtgaccagatggaccgctatggtgagatttacactacttacaagatgattttggatgctattcgtaaggtacctacggctactgttctcctaaatggtgacagtcctcttttctacaagccagctattccaaatcctgtacagtattttggttttgacttggagaaaggtccagcccagctggctcactataataccgaagggattctctgtcctgactgccaaggcatcctcaaatatgagcataatacctatgcaaacttgggtgcctatatctgtgaagactgtggatgtaaacgtcctgatctcgactatcgcttgacagaactagttgagttgaccaacaatcgctctcgctttgtcattgacggacaagaatacggtattcaaatcggtggtctctacaatatctacaacgccctagctgcggttgccatcgcccgtttcctcggcgcagattcccaactaatcaagcagggatttgataagagtcgtgctgtctttggacgccaggaaaccttccatatcggagataaggaatgtacccttgtcttgattaaaaatccagtcggtgcaactcaagctatcgaaatgattaaattagctccttatccatttagcctatctgtcctccttaatgctaactatgcagatggaattgataccagctggatctgggatgcggactttgaacagatcaccgagatggacatccccgaaatcaatgctggcggtgttcgccattctgaaatcgcacgtcgtctacgagtaactggctatccagctgataaaattactgaaacaagtagtctggaacaagttcttaaaaccattgagaaccaagactgtaagcatgcctatatcctagcaacttatactgctatgctggaattccgcgaactgctggctagtcgtcagattgttagaaaggagatgaactaatggtttatacttcactttcctcaaaagatggcatttacccttatcagctcaacattgcccacctctatggaaatctcatgaatacttatggggataatggcaacatcctcatgctcaagtatgtggctgaaaaactgggggctcatgtgacggttgacatcgtttcacttcatgatgatttcgatgaaaatcactacgacattgcctttttcggaggtggtcaagactttgaacagagtatcattgcagacgacctacctgctaaaaaagagagcattgacaactacatccaaaacgacggtgtggttctggctatctgcggtggtttccaactattgggtcaatattatgttgaagcttcagggagacgcatcgaaggactaggggtcatgggccactacacgctcaaccagaccaataaccgttttatcggggacatcaagattcataatgaagatttcaatgaaacctactatggatttgagaatcatcagggccgtaccttcctctcagatgatcaaaaaccactgggacaggttgtctatggaaatggaaataacgaagaaaaagtcggcgaaggtgttcattataagaatgtctttggttcctacttccacgggcctatcctctctcgtaatgccaatctagcttatcgcctagtcactactgccctcaagaagaaatatggtcaggacattcaactccctgcttatgaggacattctcagccaagaaatcgctgaagaatacagtgatgtcaaaagcaaggctgacttttcttaaacaaaggaaaatgatatcaaagaactccgttatcttgtcggagttctttttgtctgttcttttacccttctcccttgcattttctctcattttttgccaaaatagaggggtagaaagaaggtagcatatgtctaaattacaacaaatcgtaacatatcttgaatcagaaaaactagacgtcgctgtcgtatctgaccccgtcacaatcaattacctcactggcttttacagtgatccccatgaacgccaaatgttcctttttgtcctagcggatcaggaacccctcctttttgtcccagcccttgaagtggagcgtgcgagcagcactgtttccttcccagttgtgggctatgtggactctgaaaatccatggcaaaaaatgaaacatgctcttccacaacttgacttcaaacgtgtcgctgttgagtttgacaatctcatcttgaccaaatatcatggcttgaaaacagtttttgaaactgctgagtttaacaacctcacacctcgtatccaacgcatgcgcctcatcaaatctgctgacgaagtgcaaaaaatgatggttgcaggtctctatgcggacaaggctgttaaggttggctttgataatatttctcttgataagacagagacagatatcatcgcccaaattgactttgctatgaagcgtgaaggttatgaaatgagctttgataccatggtcttgactggtgataatgctgcaaatccacacggtattccagcagctaacaaggttgaaaatgatgctcttctcctctttgaccttggtgttctagtcaacggctatgcgtcagatatgactcgtacagtcgcagtcggcaaacctgaccaattcaagaaagatatctataacttgactcttgaagcccaacaagctgctcttgactttattaaacctggtgtgactgctcatgaagtggaccgcgctgcccgtgaggtcatcgaaaaagctggttacggagagtacttcaaccaccgtctcggtcacggtatcggtatggatgttcatgaattcccatctatcatggaaggaaacgacatggtcatcgaagaaggaatgtgcttctctgttgaaccaggtatctatatccctggtaaagtcggtgttcgtattgaagactgcggtgttgttaccaaggatggctttgacctctttacaaacaccagcaaagacttgctgtattttgattaattttctttgaaaatcttcccacaataaaacgcatagtatcaatctttcaacacctgatactatgcgtttttcttatttgaaatacttttgactcagcctctttacttaatcttcttgatactttgactaagcacaaatcctacaatcatccctaccatattttgcatgaaatttggtaaaatttctggtagagctgcagcccagccattcatcaaagtagaacccaaggcgtaaccccctaccatggcaatcgttgctaagataaggcctaaccactgagtttttcctttaaatcctgcgaaaaatccctgcaagccatggttgaccaagctaaagaacatccactgaggatagcctgataagaggtcaatcaagaaacctgctagtcctcctactacagccccttcacgactaccaaagtaaaaggccgtaaagaaaacacccgcatctaagagagttagaattcctgtcggtgttggaatttttaagaaatagcctagaaccacagagagagcggttaatagggatacaagggcgattttagttgttttggtttgcttcatattgtcttactccatactgatctgcttgtgcaatggcacggtaaacgaaagccttagagctttctactgctggtaaaagttcatcacctttgactagatgactggcaatgctggaagcaaaggtacaacctgcaccagcattttgcccttggatgacaggattttctaggactgtaaagttttgtccatcataaaagacatctacagccttgtcctgactaaggcgattgcctcctttgataatgactgctggcgctcctaaggcatgtagtttctgtgctgctgtcttcatgtcttccaagcttttaatttcttgaccagctaataattctgcttctgggaggttaggtgtaatcacactgacatgagggaaaaagcgaatcaactcttggcatagttcacttacagccacgtcgtgcgtttccttgcagaccaagacaggatccaatactacaggcactcctgggcgttgtttgataaagtccaatgccttctcagccacactgacagttggtagaagaccaatcttaattcccccaaactcgacatcacgcaagctatctaattcatgttgaaaaatggtatcgtcagttggaaagacttcaaatcctttttctgtcaaggctgtcaagcaagtcactgctacaaagccatgcaagccgttcaatgtataggtagctaaatctgctgacaaaccacctccactaaaaatatcattcccagaaagtgctaaaatacgattattcttcataacgaatctcctttaaatacaaaccattaggtgctgcagtgggaccagcaagttgcctgtcctttttctccaaaatcaagtcaatctgctctactggcatacggttgtttccgattttgagcagcgtccccaccatattgcgaatctgcttatacaagaaaccatttcctgaaaaggtaaaggtcaaaaattgtcctgtctcatcaaccctgagactagcttctgtgatggtgcgaaccttatcctccacactggttccagaggctgtaaagcctgtgaaatcgtgggtgccctctagctttttgacagcctcctgcatccgttccacatcaagcggatagggaaagtgagtagcatagtgacggcgcatgggatttttaggacgacccctatccacaataaactcataggtcttgctgtgcttggcataacggcaatgaaaatcatctgccacaagctcaatcgaaatcacatcaatatcttcaggtgactgagtgtctagagcaaaacggagcttctcctcatccatttgataaggcaagtcaaaatgaatgacctgtcccaaagcatgaactccactatcagtcctaccagcaccgtgaacagtgattgctttccctttattgagtcttgtcaaggttttttcaatttcctcctgaacgctccgcgcatgggtctggcgttgaaaaccagcaaaggcgtaaccatcataggaaatagttgctttgtatcttgtcataacttctattttatcaagaaattagtctgtagacaaggtcctaaagtaaatactgtatgggtacaaaaattctaaaaagaaaaacttaggaaccaatcctaagctctcttttgaagtaggtgcatgacaaagatagaagttacaatcaaccaaactcccaaaattgtaaagaccagcatcccattgtgagttaataagccaattgcacttagaacgaatggtgtcgtaaaggctccgaaactacagcctaatacagcaaatgaagttgcttgattgaggagtttagctggaattctttcagagacaagttgaaaaactgtcgtcaaggctacactgtaggcaaaaccagccagaatgcttcctgccactaccacccacaaggatggagataaggcaatcacaatttgccccaaaccaaaggtaataccggaccagagaagcaatttctctttaaagatagaaatcaagaaagagaaactcacaccagccacaatcccgatcaactgcatgacactaagaacaaaactagataactgggcatctccaagtcctctttccaccatcaaacttggaatacgaatagtaatagccgtattggtacaaactacaaccgccgcttcgatagctaggataaaaatcaaacctttcatttcccgagttaagcgacttgcttctttctcttttttcttgacttctttcttttcttttccataagggacaaagagcagataaagggtcagcaccaaaaatccagcactataggctaggaaggtagctgtccaaccaaaggccaacaactggccgactgccaaggtaatgagagaagccccaacgacctctgcagaaccgcgtaaccctagcatctgtattctcgtttttccttggtaacgttcactgataatagaaatggccttagcattaatcatcccaacacccaaaccaaaaagaatccgtgttccaaaaacaaaggggtaggcttgataccagaagggagccgtcccgctgagtgataaaatcagcaagcccagactaatctgtaagcgctcaggaaatattttttctaagaaaccatttagtagtaacataatcatgatcccgaaagaaggcaagctcgccaagagttcaatttgttccttaggatagccttgataatagtcaaacatggctggcagggcactcgagatggaaaaggatgtaatcaaaacgagggagagagccaaaatactggcccgttctaaaaattgtttcatgaaatctctttctatattttctcttaatcttctacttttttgatagtcatcaaacaagcaagaaaagaagaagcctctttagtgtacagactccttcttaaactcgaaaatgaatcccttgtgtcttaggatgattttctcttgatttgcttaataaagtagaagataaatcctgccaccatataagcaacaaagataatcagacaccacttgaacacgacatcccaacccttgttcacattcaaaaagaagtacgggaagggactgaccttagaattaggaacatcaagtttcaataccaagccattaaaaagagcaaaaatcatatacagcaagggtaaaatcgtccacacaattgggtcccaaatcttgtattgaccctgtttgtcaaaaaagagggtatctgctaaaaaccagaggggaacgatatagtggcaaaggaaattttctagagtatagaaattagtcgcaataggcgctaaaaggaaatggtaaatcacacaggtaatcatgatactcatggtgaccccaccttttaagcgcaagagacttggtctttgccagttttcacctaaacggctcataacctttaggagatagagcgtaaaaatcgcgactaaaaggttggacagaaccgtataatagagtaacatcccaaatccaccatgcttggcgatttcaagataaactcccgtaaaagccgctagaaacaagaagatacggctataaaatacaagtttatagtgttttgacatgcttaaattttcttcacaaactctgatttgagtttcatggcaccgaagccatcgattttacagtcgatattgtggtcgccttctacgatgcggatattcttcacgcgcgtcccttgtttcaaatcttttggcgcaccttttacttttaagtccttgatgagagttactgtatcaccgtcagccaatttattcccgttggcatcgatagcaacaagaccctcttctacatctgcaacttcagcaggattccactcataagcacactctgggcaaaccagtagggcaccgtcttcgtagacatactctgagttacattttgggcaatttggtaggttgttcatggtttctccttatcatcattcactattctttgaaaatcaaaatttctcgaacagcaactattataccttaaaatcagcattttgacaaatatagaaaaaaaccgatatcaatctatcggcttttctacatctacattctttttttagcttctgctttgattttttcaactacttcttgaatgttcaagccagttgtatcaaggtagacagcatcctctgcttgtttgagaggcgaagtctcacgatgactatccttgtagtcacgcgcagcaatttcctcttttagagtttcaaggtctgtttcaattcccttggcaatattttccttgtaacggcgctctgctctttcatctaccgaagctactaggaaaattttcaattctgcttgtggcaatacaacagtcccaatatcgcgaccgtccatgacaatcccaccttgctgggcaatctcttgttggagagaaactagtttctctcgtacttcaggaattgctgcaatagctgaaacatgattggtcacttcattttcacggataggatgggtaatatccacatctcctacaaagacaagttgttctccagtttctgagcgtccaaaactgattggatgctggtccaataaggctaaaagttcttcaacttgttcaactcctaattggttcctgagagccatgtaggtcgctgcacgatacatagcacctgtatctaggtaggtgaatccaaaatccttggcaataatctttgcgaccgtactcttgccacttgaagcaggaccgtcaatagcaatttgaatcgtcttcatttatgactcctatctagtcttaatcacatctccaggattagcaaaccaagatcctgtagccatatggccaggattcaaagcctctaactgagcaatcgagattcctgcacgagcggcaatagctgcttctccttctccagccataacttttgtagttccttctggatcagttggatgttctgagctactagatgactcttctaccttctcctctgaactagaagatgcctgctctgaactactactagaagtagaagaaacttgctctacttttgtatctgaatcgtgaaaatctttcaaggctgctgtgcgattactcccacccgatgaaagatagataagaacaataatcatcacgactacaatcacaaagaaaatacttgctaaaatagtcaagatacgattagccagcactcctccaccttgttctctcttacgacgttctgatcttgtttcttcctgattctcataaatatcttcttgccacggttcttttgccataccttactccttggttttttttacttttcttattacaatataaatatgaaaatcacacttatacctgaacgctgcattgcctgtggtctttgccaaacttattctgaattatttgattaccacgataatggaatcgtgcgtttttacgatgaccctgaccaactagaaaaagaaatctctcctagccaggacgtcgtagaagctgttagaaactgtccgacacgtgccttgattaaagattaactctaatatcgacaagaacgttccactccttctagtttagcatatttccatgcaaaattatagtcttttctctttatttttttctgtaaaatcaggaaggtcacttttttctttgacgagataaagtggtctttttttagtctctagataaatcttactaatatacttgccgagaatcccaatggtcaagagttgaatccctccgagaaagagaataacagccatcagagaggtccaacctgatgtcggattgcccaaaatgagagtccgaaccacaacaaaaaaggtcataagcagagaaataaaacaagataggagaccagccacaaaggcgataatcaagggaaaatctgaaaagttaacaatcccttcaatggagtagaaaaagagttgcctaaaactccaactggtcttgccagcctgcctttcgacatttggatagtccagatagtgggttttaaaaccgacccaggcaaagagccccttcgaaaagcgattggactcagtcaagcttaaaatagcatcgactacagatcttctcatcatgcgaaaatcacgaacacctgacggcagggctactggactaatttttttcatgaaaccataaaagagatcagcacagaaactgcgaaagaaaggttctccctcccgactagttctccgtgttccaacacagtccaagtctgcattttggtctagtaaatttttcatctcaagcaacatactcggaggatcctggaggtctgcatccatcacgaccaccagatctcctgtcgcatattgtaagcctgcatacagagctgcttctttgccaaaatttcgagagaaagaaatataatgaactgccgaattttgctcccgataggtctttaagagttccaaggtcccatcacttgatccatcgtcgacaaagacatactcgatttctgtttccaaatctggaagtaaagcttccaaagcctgataaaaaagaggaagtacttcctcttcgtttaaacaggggacaatgattgacatcaccatcttagtcttcaaatccatttggatgcttgctttgccaacgccatgcgtcttcacacatttgggtgatgcctaattctgcttcccagcccagttctgctttggcttttgcaggatctgaatagcaggctgcgatatcccctgggcgacggtctacgatacggtaaggaattggacgtcccaccgctttttccatgttttggataatttcaagaactgagtagcctttacctgttccaaggttataaacgtttaggcctgaacctttttggatttttttcagagctgcgacgtgacctttagccaaatcgacaacgtggatatagtcacgaacaccagttccgtcttccgtatcgtaatcgtctccaaacacttgcacttgctctaattttccaacggctacttgagtcacatatggcaagagattgtttggaataccgtttggattttctcccaaatctccgctctcatgagctccgattgggttgaaataacgaagtaagaccacattccattctgagtccgccttatagatatcggtcaaaatttcctctagcataagcttagtacggccgtatggattggtcactgaaagtgggaaatcttccaagattggcactgtatgaggatctccgtaaactgtcgcagaagaactgaaaataatgtttttacagttgttttcttccatgaccttcaaaagactaacagttccagcgatattgttgtcatagtaggcaagaggaatacgggtagattcaccaacagccttcaaaccagcaaagtgaatgacccctgttggttcttcttgcttgaaaatatcacgaagagtatctgtatcacggatatctgcctcataaaacggaatttcaactcctgtgattctttcaacaacttctaaactttttctattactattcacaaggttatccaccacaacaacctgatgacctgcttggattaactcaataacagtgtgggttccgataaaacctgctccacccgttaccaaaatcttttcttgcatcttttttcctcgattctcggattattttttcttattttaccatttttgatagggaatgtcatttgccatcctagagggtaggataaaatttcagtaaaatgcttatactctttgaaaatctcttcaaaccatgtcaacgtcgccttgccatatatatgttactgacttcgtcagttctatccacaacctcaaaacagtgttttgagctgacttcgtcagttctatccacaacctcaaagcagtgctttgagcagcctgcagctagtttcctagtttgttctttgattttcattgagtattattcgctttttactcgtttgacatagttttcaattgggtagtttagagggtccaaggtcaactccttgccttgaatcagttgagctagatggtagccaatgataggacccgttgtgaggcctgatgaacctagtccactggctgaatagacacctgacaattctggaacctctccaaagaaaggagagaaatcactggtataggcacggattcccacacgttcaccagatgatttcgcttctgccaaggttgggtagtgaggcaaggctgcctcctccattttctggagtaaagtttcatctaccgtcaaatcaaatcccatgtcattttcatgagtagcacctaaggacaatttcccacctgcaaaaggaatcaaatcccactccccttctggcataacaacagggtaagcttccatgtcttgggccagctgataatctcggagttgccccttttggggacgaacatctacttcataacctaaaggctctaacagatgtcccaaccaagctcccgtcgccaaaataacctgatcaaacacctcttcgtcaatctggtaacccgatgttaaaggtgtcagactcactttttctttgaccagcttgacctgactggcttctagcaaacgagtcaccaagagttgaccatctactctcgctccaccagaagcatagagcagacggtcaaatccctgcaaaccagggaataattcgttagctgatgcttggtccagaatggctaaccggcctatcaaaggagattcttctctacgctggagggctagttgatagagttcttccaacttagttttatcctttttcaggagaaagactcccgaacgctggtaaaagtcaatttctttccctgacttcactaaatcagccaacaaatccacataaaagtcagcccccaagcgcgccattttgtaccaggctttattgcgacgtttggaaaaccaaggactgataattcccgctgcggccttggtagcctgaccttgtccatggtcaaagacggttacttctaggtcactttctttagagaggtagtaggcagctgttgctcccacaattcctgctccaataatggcaacttttttcattgttttcactttctaactagatatggtggaaaggattggtcgatgcttgactaggtacaatatcaattgtccagccattttcagccttccattgagtaaggagtgcagaaattttttccacaaaaagcacttcaatatagtgacctgggtccaatgccaacaagccatcagacaacatatcctgggcagtgtggtagtaaatatcaccagtgatatagacatccgctcctttagctaaagcatccttatagaaagactgcccgctaccaccacagatggccactcttgaaataggattctgcaaatctctctcttgataatgcaccaatcgaaggctatctagaccaaagacttgcttgacatgttgggccaattcctcaaatgtctgaggttgaatatttccaatacgtccaatcccacgttcagagcctgtttcctgcagataagtcgtttcctcgatacctaacatctgacagaaccagtcattgagaccattttcaacgatgtcaatattggtatgacttacataaactgcaatgtcatgcttgatgagatcaatgtaaatctgattttgtggacggctagctaccaaatccttgatgggacggaaaatcggcgcatgcttgacaataatcaagtctacacccttttcaatggcttcaaccaccgtttcttcacgaatatcgagagccaccatgaccctttggatatccttgtctaaagtaccaatttgcagaccacgactgtctccctccatggaaaattcctgagggcaaaaggcttcatacgcattaatcacttcacttgctaacatggagaacctccttgatggcttgaattttatctactagaacttgacgttcttccagatttttttctgggatttgtccgagggcaaactctagcttaacagcttctttttgccatttttggacaaagactggactgacctctttggacaagaagggaccaaagcgaacatcactagctgatagcttcatttgtcctgcttccaccaccaaaatctcgtaaaacttgccagcctcttctaagatactttcagctacaatctgaaattcgttctcttgtagccagatacgcaagtcgtcttcacgattattgggttggaggattaaacgctctacattagctaacttgtccaagccttcttctaaaatcctggcaatcaaacgaccacccataccagcaatggtaatgaccgataccttatctacctcttcaaaggctgccaagccatttgctaaacggacttggattttctcctttaacccgtgactttcaacatttttaaccgcggactggtagggaccttctacaacctcacctgcaatggcacttttgatttgtcctctttcgaccaactcgataggcagataagcatggtcactccccacatctagtaaaatggctccctgtggcacaaaggaagccactaattctaatctctttgaaatcatcttctctcactttccaaactctattacctcttattataccacatttcagctggcaatcttgtacctaaaaagaccgcaatccacagattgcagcctttctttattttctagcttggtagcgactggtcaaaatgaaaatcacggtaaagaccaacatcatgacaccataaacaggtaatgtttgtcctgttaaggttgaaatttcaagtagtttttgaattcttgggaagagagctgtagctaggaagcctcctactgaccaaacaatcaagaggacacgccatagggtaaatggcatgcaggctctaaatacggataagaaaccaattgaccccaagagataatagagtagagttgagatttctaactcagaccaaccttggctacttccaaatattttcacaaaaagaacgctgaacacaaccatgagagcacttggtagagcacgaagcatggatcttctgaggaagtttggctcaacaggtttgatatttcgctcaaaagtcagaacgaatggtgggaaaccttccacgaactggtcaatcatggtaatctggatcggaatgaaagggaagatcaagatccactcagatcgtcccagaagagcactggcgatacagataactgcgagcaagaaagaatagatggtctttatcaagaaaatcggggcgatatgggcaatgttattgaccacgcgacgaccttcaaagagaatctcaggaacatcattaaagtctgagttcaagagaaccagattggcaatctgacgcgtcgccggatccccttccgccatcacgatagaacaatccgcctcacgaagggcgagaatatcattgactccgtctcctgtcatagctgttgtatgccccgcttttttcagtgtttggataatgagtttcttttgatgaggggaaacacgtccgaaaatagctgtctcctcagccatagtaatcaattcctcatccgtgattttcgagcaatctacatagctatgatagtccgcaaaaccagccttctgggcaatactggacaccgtaactggattgtcaccagagatgatcttgagacccacttcctgagaacggagatagtccaacgtctctgctgctccctctcgaatcggatccaagatttccagcagggccagagcctgaatatcagatggtttctgtggcttgtgatggtctaatttctcctgactgagtgccaagaccaagacacgtgatcctctctctagagcctctctggcttctgggacctcagaagccagcaacatctcaggcgcccctaaaaaaactgtccccaaaccttctaactctatggctccccacttgcggtcgctagagaagggaagattggaaagcataggataggctacctgaccttggaaacgctggcgaatagcttgagctgttggattcttatcctcactatgggccatatagcttgtcaggatgctagcaatagcctcgtcaccataagtttccgtcaacggaagaacagcctctacctgcatctttccttgggtgatggtgcccgtcttgtccaaacagagcatatccacacgcgccaaggtttcaacagagtacatctcctgcaccaaaacctttttcaaacctagcttgataactgcagtcaagagcgaagtaatggtcaaaagggcaattcccttaggtaacatccccaaaagggctgtagacgagtttacaacggacgacttaagaggcaagccttttaacatcaaggcttctagcaagagagccagaccaaaaggaatgataatctttccagtaaaacctgctaacttgtccagcgatttcatgatacgagagttgattggtttaacggtcttggcttccagcatgagtttggcagcatagttatcagccccaacatggtgaacttgagccaaaactgccccactagccaagaaacttcctgacaagagcaaggcatccacttccttttgcaccaaatcactttctcccgttagcatggcttcattaacctccgtaaagccttccaaaaccaaggcatcactaggaatctgctctcctgcagacaaacgaatgacatctcctaacaccaattcttcaggattcagagctacttcttggccatcacgaatggttttaaccttttccttggtcatgagattgagcttgtccaccatgtgtttagcccgcagctcggtcacaattccagaaaaagcgttaaagcagataacggcaaagaagaccagattgctccaagcttgcacaaaggcaagggccaaagcaatggcaaagttcaaagcgttaaaaagggtaaagacatttcgtttaacgatttgccaagtgctggtactggccgaagcagtaaaatcattgaccaagcccttagcctgtctttcctcgacttctatttgggttaatcccataatcttatttttatccataaattctatcatatcattttttctaaaagaattctaatctcaccccaaatatgcacctagtcaagggaaaagtttgccagccctcctttgataaggtataataataacaagaaaataatcgaaggagatcgcatgttttatacttatttacgtggattggttgtcttgctcctatggtccatcaatggcaatgcccattatcataatactgataaaattcctaatcaagatgaaaattatattttggttgcacctcaccgcacctggtgggatccagtttatatggcctttgcgaccaaaccaaaacaatttatctttatggccaaaaaagagctctttaccaaccgtatctttggctggtggattcgtatgtgtggtgcctttcctatcgaccgtgaaaatcctagcgcctcagccatcaaatatcctatcaatgttcttaaaaaaagtgaccgctctctcatcatgtttccaagtggaagccgacactcaaacgatgtcaagggtggcgtagctctgattgccaaaatggccaaggtccgtattatgccggttacctacacaggtcccatgactttgaagggcttgattagtcgtgaacgtgtcgatatgaactttggaaatccaattgatatctcagatatcaaaaaaatgaatgacgaaggcattgaaacagtcgccaatcgtatccaaacagaatttcaacgtctggaccaagaaacgaaacaatggcacaataataaaaaaccaaacccactctggtggcttatccgcatccctgccctcatccttgccattatcctcgctatcctaaccatcatctttagctttatcgcaagctttatctggaatccagataagaaaagagaaaaacttgcttaaataaatacaacaatcccttggcaaaagccaagggataaattttttattcgattttccatttttgggccaaccagctagaaaaagctagaaatcgttcagctacttgttcatggtgtccataagggtcaaagacaaactggccgttcggatagcgtttctgaagactggtatggatctgctcagcatagactggtgcttgagccaagcgattagtgtggtgttctccttctgtttgaccattctgtaaatacagcaaacagtccaaatttttcacattttcttccttgcagtaggtcacaaaatcaggataccaaaaggaaccgcagatcgaaaagacacaggaaaccttgtcaaagctgaaaagactgtagactgctgccaaaccacctagtgagtagcctccataagcaaggcgtgcttcatccagtcgataaagcgactgcaacttgtctaaaagacctccaaataaatgatcatgataggcgttggcctgacctccaaaatctggagctccatctctcagagctgctaccttccagggagtgtagtcatctaggcgatttttagaggtcaagcccactaaaatcacagattcggaaagggaagataggaaatccaagtttccatcattcaataaaatagtcggataggtttgattggggttgtagttagagggaaggctgattttgacttgaattccttcccaatcaaactcattatttattgataaagtcattgattttctcaagggaatcaatcacagctgggccataatccatcaactcatcgtaagagatagtcatgattttttgattcttaatagcaggaacaccttccaaaacagcatttgccttcatcaactctactgcgttagcatccaattttttattacggtcactggttacatagataattaactcaggatccattgacacgagattttccaaggtcaagcctgatgtccccgtagcaacgtttgtataaccaagttggttcagcaaactctcttgcaaagcagacttgtaggcaccgaaggtttcatcattataagcaaccataatcaaagcctttttcttttcaccttggcttgctggatttgctttcttaacagcgtcaattttagcttgtaattgggctgcgtattcattggccttgtcctgaacattaaaaatcattccaagatttttgacatcttctacgatattccccaaatcttgctgaatcgttgagagggaagctttttgcgtataaactgggattttattttcattccaagtgctaactgtccccaaggatttttcagaaaacatcatgtttcgacccatcaaagcgtctggttcataagaaaggactgtctcttgtgagactgtttttttatccccaatttgaggaatcgtcgcaatcgcgtccttgtatttgtccgtcacagcattgtctggattgagcatgccaacaattttatccttcaaccctaactccaataagatttcagtggttgaaagattattggtgataactttttcaggtgccttgtcaaaaacttgttcgacttcatttcctttagcatcataggttttgaccgttaacggataagtcgtctctgcgctggccttctgacttgtttctgtgctagattgtgtggtagctttttctttagtagtattgccacatgctgccatggttagggtagctactgttacgagtaaaatgctgagtgtttttttcatcttgttttccttttcattcttataaatagtgaatcatggcttgctgatcctcggtccaagtaacctgactttgaactccgtatacagtttgcaatgactcaggggtgatggtctcctttggagtcccttggtaaaggatttctccctctttcatcagatagagataatccgaatagcgacaagcaagttgaatatcatgcaggacagctagaacattaaccttgagatttttcacaatggccaacaagtctagctgatacttgatatccagatgattggttggttcgtctaggagtaagagagtcggttcctgcgccaaggcgcgagctaacaaaactcgctgtttctctccccctgacagagacgaatagagacgagttttcttctcaagcatatccaccttaacgagagcatcttgaacgagtgtaaaatctctttccctttccttctctaaaaaagagaggtggggagttcttcccagcaagacgatttcctcaactgtacaatcaaactgcagctggttaaactgggtcacaactgccatttgcttggctgtttctttgagtgaccaatgatccagcggctttccatctaggcttatcaagcctttgtccgccttttcctgacgatagaggagtttaagtaggctggtttttccacttccatttggccctaatatcgtgtgaaattgattcccttcaactttaagagaaactcccttgaggatttttttctctcccagtccaaagtgaatatcctgacaaatcaaatccatatcagcccctcacctcccttcgcctacctccgacaatgtagataaagaagggagcacctactaaggctgtgaaaataccaataggaagctctgcatttggaataatgacacgagagagtacatctgcccagacgacaaaaagggcacctagcaaggttgcaacaggaaaaagcctcttgtaattcgttcctactaaccctcgagctaaatgtggagtaatcagaccgacaaatccaataatcccacaggttgccactaagactgctgtcagcacagccaccatggtcacataaagataccaataaaagcgtaagggaatccccaaagttaaagcagcctcatctcccatcatcatcgcattgaaaacacgatactgagtagagaaaaatagaaaggctattcctactactatagttggcaggaccaagtctgcccaggaagtcccagcgagcgatcccatggtccaaaacttaatggtcatcacactatccgcattagcgccaattgagataataaagtttgaaaaagccagaaagagagcattgaccacggttcctgataaaatcagactagaagtcgtcatccttccctgcatagaggcaatgatgaggacagcaattgttgccaaaatagctccaagaaaagctccaaggctaatcatcacttttaaaccaagaatgatgctcaaggttgcccctagagttgcacccgcagatattcctaagacataaggctctgcgataggattgttcactgtggactgcatcacgctaccacacatagaaaggcctgctcctactatcagacctaacaatactcgagggaatctcatgttccatacaatggcaagagtggacttggaaacctctcctacctcaagaggaaatcccaacctgctcaaaataatccgataggtatctcctagattaatcgcaacagatcccattgaaactgctagaaagagagaaatccctaaaatacctagcaaaataactaaaagtaacacaaattgctggtcttgtcggcttccagaaaattttggaaagcatgcaaacctcctttgatagaatcttaaaaatttagaaaattctcatgaaaagtataccatattttcaactgtgtaacaagctatggaaaaaatacaattaaaatcagaaaaattatggttggtttttccatacagttctaggaaccgtaaccaaagataatacttgagcataccaaggtaaggtgacaatgtaaaaagccctctgaaaatcagagagctgatttgagctcgggctaaaatcctagtgaaacaaaaaaatctacacgatcagaaaagtctctatcgtgccattttcatacatgatatatagtccaagtagaatgaatactaagggcacaatgattcgctcgtatttttcaattgtctcgaatattaacggaatagaggataacacccgactaagctcgcataagataattatgccgattacaaacacaagcaacgccacgagggtctgtgaccaatctaacgaagcaaaataaggtatatagatacctaaattatctccgccagacgcaattgtcagcaatgtaactgtccaaaacagttgatttgccttgctttgttctaatctttcaataatttcttcctcttcttcctcttcttcctcaccttctccaacaattgcaaagcgaatccctaaatagataggaattaaaccaagcaatccaaccatccattcttcaggcacgaaattaacaacataagcagcaactaaactcgcccctacaagtaagcctgtgcctagatattgccccgcataaatatgccatttttgtttattctgtgatagctgtgcaaataaaataattaaaataattaaataatcgatactggtggaaatataaacaccaatagcagatatgattgtctgtcccataaaaaacctcctgtattggtcagtaataaatcagcagattttaggagagcacagacacattaatttagctatcgctagtgggtaatgtcgaacataggaaagcattttactcctcctcaaaacgtagttacaaagtaatttctaactggaattcagtaactacttccatgtagagtataacatactatactttacttcgtaaagtgtgggctctccgaaggggcttgcagacagctactcggcttttcaagccgagtagctacgcacctttatggtgtaattagctgataccatttgaggtttttgtagtctccaaaattgtgaccgataaaacctcaataaaaaagccctctgaagtccgagagctgatttgagcccgggctaaaatcctagtgaaaaagatgaaactccttgtgttcatcgaacacggtgtcgtttccctattttcatacggatttcttacgcccttagcatcatgattcttgctggataaaacgtttatagattaggcggtaagccgaagattgtacaaaatttttagtaaaagataaattgtaagaataagtgcaacatttacttgaactcatcctctagggcttcacaagcatttctgtaagctaaacactttcgtggtcggtgattgatgtcatataaggcctttttcaaagcctcatcagaaatagcggctaaatctgttttctttgggaaatattctcttagtaagccatttgagttttcattgcttcctctctgccaggaataataggcatactcaaagaaaaagggaattcctaagttctctaccagaggatagcaggcaaactctaaaattggaatttcatgtttgtgtatcatctgttgcctcctaagttttaagaattattatatcaaaaaataaccactgtaatatgatttcataggaactacttcccaagaatcacaaagaaaaaccaattaaacaatgtacataactgaaaagaaaggacataaatctgctttagtcagaaacatgtcctttttgtgttttattttaagaaatatcatttcagtcggcgtttatttccacaaaccacctaaaatctgtttttccaacaaattcaagtcttcttctcttatgtcactattgtcgctaacgatatagagttgggcaaagtaggccaataagggacctataaaaatacgaaccatttgaggaaccgtgatttcaggattcactcgtgaatctgctatcaattccttatggagtactaataatttatcctgaagagtattccaaatataaagttgttcttttctcagtttcttatttgaaaaaatttcctgaagaataattttcatcaaagcgcgattcgttttgagataggccatacgattttggaccagataatgcaccttttcttcagtcgtttctaaggctaaaagttcttcaaaaaaacgaccgaaaagtcctggaacaacagggtgcaaaatagccgttaataaatcttctttggtcttgaaatacttgaagagcgttgcttggctaagtcccgcatgtttggcaatttgtaaggtggaggtcccattgtaactcttagtagaaatcaaatcgaccgccgcctgcatgatttttttctttcccttgggatagtctgccccctttagataagcttcaaacgactcaaaaacactctcactcattttcatcctcgtacatttacattttatactttacggtaacgacgcaagccgacaatattgagaactgtcaaagcgacaaggaagactagtagaacaccaatatttggtaaaatatctccaagtccacgtccgtaaagaataatctgactcatcgcatcacctgagtaggtcaaaggcaagaatttccctagcgtttttacccagtctcccattgaatcaagtggaatgattcctgaaaaaaagagttgcggcataatcacaagaggaataaattgcatcatctggaattctgattttgccaaggtagacaagagaattccgaaggctagtgccaccagagccagtaccacattaactattataacatttaacagacttccgacaacttcaattttcaacaaccagatggctgctagaacgactactcctgtctgcagtatggcaataaagccgtaagacaacatatagccgtaaacaatttccgaacgtttaactggggttgccaacaaacgatctagggttccgctagtacgttctttcaagagtgccatccctgaaatcaaaaagacaaagaagaaaacgacgaacccaagcaaaacaggaatcattttagcaaagaagccggtgtcctcgttaccatattcataagattccttaatttcaggagattttacctttagttctaattgcggaagggattgcttcacacgggctaataattgattagtgtcttcactggcaatactggtgcgtaatacttgtcggatcaccgaagttttagaggcatctgtattagcataggctacattatattccccatccttataagagataactgcatctactttttcatcgtttaaagcctctttagcttgatccaagtctttgtatgttttgacactgacatgctctaagtcatccatcctacttaccaaactacttggcacatcttgtatcgctagcttaacagtcaccgttgtactagccgaaaacatgaggttcatcagccacataataaagactggtgccacaaacattagggccagtgtccgtttgtcacgtagcaattctttgatgactttttttgcaatggcaattgttctcatttcattctccttctgctttcaaaaagacttcttcaatacttgaaacaccataagattcttttagcttggatggtgtatcaaaggctatgatttttccacctaatagtagaccgaccttatctgtcagctctgcctcatccatgacgtgagttgtgaccaaaatccctacacccttgtctctatgcgccatcaactctcgccagattttctttcgaagagaagggtcgattccaaccgtcggttcgtccaaaatcaagagttgagggtttcctaaaagcgcaatagccagcgacaagcgtcgtttcatccctccggaataaccagacacggccttatttaaatgatctgtcaagtctaccacttgagccacatgggtaatttcagctgtcaaatcttttttaggaatcccttttagctggccgaaaaattccaagttttcttgtcctgacaaagcctcataaagagcatctgactgggccatatagccaatatctcccagaatatgacgattgggcatggtctggtctaagactaaagcgataccgctatctgccttttccatccctaacatggttttaatcatggttgatttaccagcaccagaaggaccgattagaccaatgatttccccagactgtaattcaaaaccaacgtggtttaacacaagttgttgaccaaaagatttttgtaaatcttgtaaatgtagcaatgttttcatttacttcctcctaggtgagcgagcacttacttttttaaagataaatctattatagtgagtgaatactcacttgtcaagtgatgatttgaatttttttaaaacaaaaaatctccccgtagggagaatatctggtttattttaccttacagtgctaggaaccgtaacctaagattatacttgagcataccaaggtaaggtgacaacgtaaaaagccctctgaaaatcagagagctccagtcttgctggataaaccgtttatagactaggcgacgaggcgaagattgtacaaaatttttagtgaaacaaaaaaatctccccgtagggagaatatctggtttattttaccttacagtgctaggaaccgtaaccaaagataatacttgagcatatcaaggtaaggtgacaacgtaaaaagccctctgaaaatcagagagctacagtcttgctggataaaccgtttatagactaggcgacgaggcgaagattgtacaaaatttttagtgaaacaaaaaaatctccccgaagggagatcattctggtttattttaccttacagtgctaggaaccgtaaccgaagataatacttgagtatatcgaggtaaggtgacaacgcaatgtaagtggaaaataaagcagattaacgacgaagtcctagagagttgatcaactcacggtaacggttaacgtcgtttttacgcaagtatgcaagcaagttacgacggcgaccgatttttttcatcaatccacggtaagtagcgtggtcttttttgtgttgtttgatgtgttcgttaaggtggttgatttcccaagtaaggacagcaacttgaacctctactgaacctgtatcaccttcgtgacgtgcatattgtgcgatgatttcattttttttctcttttgagattgccatgatgtttctcctttttatttggcttcatccgagtgacaggttggcatgcctgtaaccaagaagaagttatttgtctttacgacaatccctattctaccaataactaacttctttgtcaacagatttactttcttgttttaaagatgctataataatcatagcaagaaatctaagttatctgttttttaaaacgaggtgattatcatgcgtagattctatttccatctcccctactatctggtcatatttttcttttattggccactttatgagttgttcttgctagttgtttctgaccccctcacactcaagggactctatataaacaatcttctcttctttacacctctggtaatcttgattatatcgctactctatagctaccgtttccgtttctcactttggtggttaattggtaacggactgctcttttgctttactatcataacttttggtgagtttatactaatttacttgctaatctatgaaaccttggctctggtgggcatggcttccggtattggcatcaagcatattctacaaaaatgaaaaacaaaaaactttcacaaaatccttgaaaaatctcacaatcatgctataataatccatagagacaagtcacttagtccctttctactagagagtgcgtggttgctggaaacgcataggaagtctaaactgatactactcttgagtttttatgaaaacataaaacggtggccacgttagagccaatcagaggtgtccctcttttttgaggaacataaatgaaggtggaaccacgttacgacgtcctttttaggatgtcgctttttgtttttctagctttcacaatcctctgtccctgttttcagaatagggttaacacattcgtcaataatataagtaaggagaacatcatgattaacattactttcccagacggcgctgttcgtgaattcgaatctggcgttacaacttttgaaattgcccaatctatcagcaattccctagctaaaaaggccttggctggtaaattcaacggcaaactcatcgacactactcgcgctatcactgaagatggaagcatcgaaattgtgacacctgaccacgaagatgcccttccaatcttgcgtcactcagctgctcacttgttcgcccaagcagctcgtcgtcttttcccagacattcacttgggagttggtccagccatcgaagatggtttctactatgatactgacaacactgctggtcaaatctctaacgaagaccttcctcgtatcgaagaagaaatgcaaaaaatcgtcaaagaaaacttcccatcaattcgtgaagaagtgactaaagacgaggcacgtgaaatcttcaagaacgacccttacaaattagaattgattgaagaacactcagaagacgaaggtggtttgaccatctaccgtcagggtgaatacgtggacctttgccgtggtcctcacgtcccatcaacaggccgtatccaaatcttccaccttcttaacgtagctggtgcttactggcgtggaaatagcgacaacgctatgatgcaacgtatctatggtacagcttggtttgacaagaaagacttgaaaagctaccttcaaatgcgtgaagaagccaaagaacgtgaccaccgtaaacttggtaaagagcttgatttattcatgatttctcaagaggttggtcaagggcttccattctggttgccaaatggtgcgactattcgtcgtgagttggaacgctacatcgtagacaaagagctagcttctggctaccaacacgtctacactccaccacttgcttctgttgagctttacaagacttctggtcactgggatcattatcaagaagacatgttcccaactatggacatgggtgacggggaagaatttgtccttcgtccaatgaactgcccgcaccacatccaagttttcaaacaccatgttcactcttaccgtgagttgccaatccgtatcgctgaaatcggtatgatgcaccgttatgaaaaatctggtgccctcactggtcttcaacgtgtacgtgaaatgtcactcaacgacggtcacctcttcgttactccagaacaaatccaagaagaattccaacgtgcccttcagttgattatcgatgtttatgaagatttcaacttgactgaataccgcttccgcctctctcttcgtgaccctcaagatactcataagtactttgataacgatgagatgtgggaaaatgcccaaactatgcttcgtgcagctcttgatgaaatgggtgtggattactttgaagccgaaggtgaagcagccttctacggaccaaaattggatattcaagttaaaaccgctcttggaaaagaagaaactctttctactatccagcttgacttcttgcttccagaacgcttcgaccttaaatacatcggagctgatggcgaagagcaccgtccagttatgattcaccgtggtgttatttcaactatggaacgcttcactgctatcttgattgagaactacaagggtgccttcccaacatggcttgcaccacaccaagtaaccctcatcccagtatctaacgaaaaacacgtagactacgcatgggaagtagctaagaaactccgtgaccgtggtgtccgtgcagacgtagatgagcgcaatgaaaaaatgcagttcaagatccgtgcttcacaaacaagcaagattccttaccaattgattgttggggacaaggaaatggaagacggaactgttaacgttcgtcgctatggccaaaaagaaacacaaactgtctcagttgatgactttgttcaagctatccttgctgatatcgccaacaaatcacgcgttgagaaataagagataaaacctgggataaaatcctagctacctaaaaagcaacaactatttcagctgttgctttttatattttatttaacctgagctagtagtgattgatcaaaccaccacacaagatttgctttcatgagttagatatggtcaatatcctcaatccttgtctgcttcattttcttttacgagatctttttgtgaatccttttcagagagtttttgatcgatatacttgttaatggtttcataaaattccttggtcgaatcactgtctaattttgtcgaattatgaacttgattgactttcaattgaacagattgaataccgtaagaggcttgtttttggtggagcgtttctaattcttcttctgaaagcggatctccaacaaccgtcaagaccaactcattgtttcttgatttgtagacttgattaatgaccgtgtgattggcgaactcttttcctacaaactgtttgattccttcttttcgcgcttgatctatcgttagagtgactgctgaatagctggccggaagaatcaataatacaatcaaggatatcaacccaattctcattttaatgtttagctctttaaatgaacttaagggagattttctcatcataattcttgttccaacaatgttgattagcatgataaagacacagttgatcaagaaaagatagagagccccaaataaaaatcgtacatttccattagctaaaccgtaacctgcagtgcagataggtggcatcagagctgttgcgatggctactcctggtacgatattgtttgcttcttttttccttgaaccaatgaaacctgctatcccaccagcaatagcaatgagcacatcccaaattgttggagaggttcgtgcaatcaattcgctactttcataagataagggagaaatccagaaatacagagccgagacaagcaagctaaccaatacttgggtaaataaaacctctagagattgcttgattaaacgcgtatcaaaaatagctaaaccaaatccgagtccaacaatcggtgtcataagaggggaaatcagcatggctccaataatgacagctgttgaattcatatttaggccaatagaggcaataaaaatcgcacacatcaaaatcactgtatctcttaatcgaacatgaagatcatcatataatttctcacggtattcacgtgttgaatagtttccggtcattggttactccttttatttcatataatcttgtttctgcatagatgatggtagagagacttctgtccaatcttacatatttttcttctcacctattattcttttgaaaataatcctctaagtatccgtcagtccatccttaacattatatcaaaaattttacagtctttctctgaggaaatctctcaatttaacagatagatgaagcaagaaatttttgtttccttatccgaagaaggaaaaacgatatctcctgaaccttgatactatgcgttttattctttataatttagctatttcaaaattacaagttctccattcttaatttcccaaacttggtcaaacttacttaataattcgttttggcgatgtaaagtaacaatgacggcacttggtagttccagaactctttccaattccattttaaactgattagtatccaaggcagagaaaggttcgtctaggataagcaatggatttttacgatttttctcacgatttaaatacattcgttgttgctgaccacctgacagggattgtggtggaattttttcaaaatcttcttctctgaatttttcattgaaactattgaatagcgttacattattttcataacttgaaataaatgtatgttcttgttgcagaatcataccgaatcttccccaaagatggtccaaaacaagcccatctagcacaatttgtccttcaaaatcttcatctgttccatttaaaatgttgagaagactactttttccagacccattcttaccaataagcgcaattttatcccctttttgaatcgtagcggaagtaattatcaattttgattctcccatttgtttggaaatgtttttcaaagtaatcgtatcaaaagaatgttgaggtgcttgaactgaaacgggtctcccaacaatgttttgaaaactcttgattacaggctttacggactctaacatttgtaaatcataaaggatttcctgtattggttcagaaaaagcattaatatatccgaaactcgccaccacctcaggaataccgagttgctggtgagatagagagtaggctaaataaataaacagaacaagactaatgaattcaaaagaaacacctgtcaataagatgccagtaatttttgtcaaaccatacttaaaatacttatcctgcaaattctttagagaactcttttgttgattcaaaaaatgcgacatagttagtttatttaccaaatgatgtcccatgagcaaatcctccaaagttcgatagtaatctccttgttttttcaagtaaacctgtctgcgattagcggtcaacttcccaacgattttaggaatttgaatactaattccagtggaaaagattaaaatcaatgatacaataggattaattgttctgctaataatgaaagcgtaaatgatgatacgtaaaatttgtttgataaaactcatcaatggaggaaggtaatccttttccaacgaatctaggtcattagattgataggaaatatactctgctactgttttctgcttgaaatcgtggtgactgagtcccagaagtgaacgaaaccactcatttttcaaagtagtcgaaaagataatcccctgcttccaatcaagtatcatttggatatagttacaactcaaatagccagccactgacatagagtaaccatatagagctacttgataatcccctttgattaatgcctgcgtgaaatacggtaacaaagctgtgcagatattcgatactacaccaaaaagaaaattaaagaagagataccatctaatagttttaagatatggtagcatatacgatactccttactaatgcgtttttttacatatcgcagaacaatctctactattccctatttcagatagtgcgatactcggacattgagtgcaataattgtaaatcacacaagtactgcagtttttactatcattcaaaataaaaagaaagctgcagttcttttaatcctgtatcaacgattcattctgaaatcgaataggagacatttcccaagtctacaattcacttcatctcaaattaatttctgtaattcacccttagtttatagattttatactcaacaaaagtataaagcatacaaaacttcactttgaaccagtatttatactatattccgtattaaaaattctattattggttttgaaaaaaacagtcttcaaatatcctgaaatatagcaaaaagagattgggtaaaaactcattgtctcttctcactcaaggactaagttcacttgagcaaactgaatccgcactgtcgttccttttccgacctcagactcgatgcgaatctggtgccccagttcttcagaaattttcttagataggtagaggccaagtccagatgactgctgggttaggcgtccattatatcctgaaaagccacgttcaaagactcggaggacatcactgttttttatcccgattcccgtatccttgatacaaagctcttgcccctccatataaatctccagaccaccttccttggtgtacttgagacagtttgagatgatttgctcaataaccactagcagccactttttatccgtcacgatttctttatcaaggtcatgtagattgacatttaagcctttttgaataaagaaaagagcatatttacgaattatttccttgaccaaatcctcaatttgcacctgctttaagaccaaatcatcatgaaaactttctaaacgcaggtactgtaagactagattagtataggagtcgattttgaaaatttcctgttctaattgctgcttcagttggcggtcggctacttctgcaactaagagttgactagctgcaatgggggtcttaatctgatgaacccacaaggtatagtaatccagcaaatccgtcaattttctttctgaatctgacctctgctgataaagttccatctcacgcgcttctaatttttctgctaaaactatttccaaaggagatttggcttccctctccccatagagaatttcctgacgatagacctgcatttccaccaatatgtcccaagtgaaaaataagatggttacaaagcaacacaagaggaaaaagtagagaaagtaaattcccaaactggcaaataaaaactgaaagagtaagagcagaaacgtcaaagaaatcagatagacaaacagacgactacgggaacgcagataggctagaaaaaattgtttccaatcaagcatgctttaatccgtaccctatccctttcttggtttcgataaatcctaccaagccctgctcttccaactttttacgcaatcgagccacattaacagatagggtattgtcatcaatgaaaaagtcactgttccaaagttcccgcatgagatcgtcacgcgctacaatattgcccgcatgctcaaacaaaactcgtaaaatctggaattcgttcttggtcaaattcaagacttgcccttgataatgtaaatccattgatttggtattgaggataacaccagcatattccagtaaactctcgtcacgcccaaactcatatgaacgtcgcaacaagccctgaactttggctaaaagaacctgctggtcaaaaggcttggtcacaaagtcatccgcccccatattgattgccatgacaatatccatagcctggtctctcgaagacagaaacatgatggggaccttggaaatcttgcgaatttcctgacaccagtgatagccattaaacaagggcagtccaatatccatgaggaccagatgaggctccgactggacaaaaagactcaaaacttccataaagtcttctaccagcaccacttcaaatccccattcagagagcattttcccgacctgttgacgaataacctgatcatcttctactaataaaatcttgtgcatgcgctcctccttttctattattataacagatttttcaatgctagaagatctgaaactgaatttgaagcagcttgtttttaggcaacaaaatgaggcaatcctactagctaatttaagggaaatttgataagataaataaaaagaaaggagctcttatggccaatatttttgactatctgaaagatgtcgcacacgattccttttacgacctacctttgaatgaattagatgttttagccttaacagaaaccacctacctctcctttgataatctggtctccacaactcctcagcgacttttagacctggcacctcaggttccaagagagcctaacatgttgaccagcaaaaatcgcctccagctattggatgaattagctcgacacaaacgcttcaaaaattgcaaactctcccattttatcaatgacatcaatcctgaattgcaaaaacaatttgcagctatgacctaccacctcaatctcgatacctatctgattgtctttcgtgggactgatgacagtatcattggctggaaggaagatttccacctgacttatatgaaggaaattcctgctcaaaagcatgccctccgctatttaaagaacttttttgcccaccatcctaagcaaaaggtcattctggctggacattccaagggaggaaatttagccatctatgctgctagtcaaattgagaaaaacttgcaaaatcaaatcacagcagtttatacctttgatgcgcctggtctccacacagaattgacacaaaccgagggctatcaaaggataatggataaaaccaaggtcttcattccacaaggttccatcatcggtatgatgctagaaatccctaaccagcaaatcatcgtgcacagtactgctttgggtggtatcgcccagcacgatacctttagttggcagattgaggacaagcacttcgtccaactggataaaaccaacagtgatagccaacaagttgacataaccttcaaagaatgggtggccacagtccctgacgaggaactccagctctacttcgatctcttctttggcaccattcttgattctggtattacttctatcaatgacttgtcttccttaaaggctatcgaacacattcatcatctcttcgtccaagctcaatccctaactccagaagaaagggaaactatgggacgtctcactcaattattgattgatacccgttaccaagcatggaaaaatagatagtactcttgaaaatcaaatgtatacaaaacaaaagacctagaatacatactttcatgtgcattctaagtctttttaaatagaatctgactaccaaataattcctttgtaggctatcaaaatgagtgctaatagcaggacataaaaggcaaggaaaagccatttcattttgacacagagagctacgtactcccgaataaaagcagatggtatgtagtagcctgccgtcctacatccgaggccatctcccttcatttttaacttacgagcataggtacttgttctaaagacatgataatcatttgttacaaagaggaattgaggtttggctaccagcttctcaccaagttccttagaaaagagaaggttctcgtaggtagtccttgattggtcctccaggataatcccatcttggggaacatcggtctcttcaagcagatagtttgtaatagcctgcgcttcagaaatcttctcatctcctccttgaccaccactagcaatgattttgatatgaggattcttagaattgtggtaagcttctactgccttatcaattctcctctttagcaaaggtgttaccttttctccgtctaacaaacctgcaccatgaatgatgataaaatcataatgcttcttcttaggaataaagagatacaagatagagtacaacataaaacccacaaaagcaaaaccaaaaataaagtaagaataagcaataaatgcaaataaaatgtttagaaagtgattggtgtaaaataattcatttctatcacccaatcgaaatgacatcaaggcaaaaaataacaaaatgactattccaaggagcattgagagataattagcctttgaacgtccctctcgcttcagcaagataaggccattatagattaaaaagatgccacttagaaaaagcagtatcggaagtaaaataaagggaaatataaaaaaagcgaaatgaatcttctcatacccattttgataaaaaaggtagcctagataaaaataactggaaatgagggataataagaataatactggattccacaaacttctattatctttccaaaatgacactataaaggctaatacaattcctataacaagatacatttcttcctcctttaatgattctattttatcacaattttacatagagaaaaagagggcatctacccctctcactccttcatttgactctctgcatcggctacgacctgttctagactggtctgaccaagctcagcctccatagccagctggattctctccaatttttgatccaaaacatcatgaatatgagctccaactgggcaatttggatttggattgtcatgaaaactgaagagttggcctgtcttaccaagacattcgaccgcttgataaacatctaaaagactaatgtctttgagatccttaacaatctctgttccgcccgttccgcgcgcgactgaaatcagctctgccttcttcaactgggacaaggtctttctgataatgactggattgaccccgacactagcagccagaaaatcactggtcaccttgctttccttcccctcgagggcaataattatcagcatatgagtcgcaatggtaaatctacttggaatttgcatcctcttctcctttttacgaggctaccctgcctctactcttctttttctattattataccctttttagttgtaatgtcaatcgttaccacttttcaaccaagcatctaattccctatcatagccctctttctgggctaattctctcagaaattcctgatgatgagtatggtggataccattgaccagactttcatagtaaacctcaaaatagggaagtttgaggtctttagctagctgcaattcagctgccacatcgtagtccacccgtcggaagtccatatctaccaagcccttgtcatcaaactccaaaatcatatactgggcccgtaagtccttccgcaactgggcatctagaaagaaaggttgcccaatcgaacctggattgacaatcaattgcccaccagtcccgtaacgaagcaactgctggtggatatgaccatagacagcaatatcacaaggcggattggtcaccaagcggtcaaaatcctcttgttctccagtgtgaatcaactctctcccccagttcttatcaggaagatgatggctaattcccaccgtcaaatccccaaactgacgatgaatctggagaggttgattgtggagcagttcaatttcttctagggaaatttcctctaaaacatactgacactggcgcaagagatagcgttgactgggacgagtactatccaattccttgcggacaccatgccacaaactgtcttcccagtttcccaaaactctagccgtaatcggtagttgagccaacaagtccaaaatccttctacgccctgtccctggcatgagaatgtctcccaaaagccagtattcatccactcctagctgccgcgcatctgctaaaactgcctctaaagcagtggtattaccatgaatatctgaaagaagagctattttcgtcatatccatctcctcgttttttctcttgcaataagtataacataaaaagtcacagctagagaaatctagctttttttgatatactagatatagatattagacaagaggaagcgaatgaccccgaataaagaagactatctaaaatgtatttatgaaattggcatagatttgcataaaatcaccaacaaggaaattgcggctcgcatgcaagtctctccccctgccgtaactgaaatgattaaacggatgaagagcgaaaacctcatccttaaggacaaggaatgtggctatctactgactgacctcggcctcaaattggtctctgagctctatcgtaagcatcgcttgattgaagtttttctagtccatcatttagactatacaagtgaccagattcacgaggaagctgaggtcttggaacatactgtctctgacctgttcgtggaaagactggataaattgctaggatttcccaagacctgtcctcatggaggaactattcctgtcaagggagaactcttagttgaaatcaataacctgccactagctgatatcaaggaagctggcgcctaccgcctgactcgggtgcacgatagttttgacattctccattatctggataagcactcacttcgcatcggtgatccgctccaagtcaagcagtttgatggcttcagtaacacctttactatccttagtaaagacgaggatttacaagtgaatatggacattgcaaaacaactctatgtcgagaaaatcaactaatttctcaagtcccccaaccaaccctgaaagttttattttcagggttttatttctatcatttgattttgctttcatttaattgtagaatatttgtaaaaaaaaagaaagatagtttaaactatgaaaaaatcactaaaaatttttgctacatctaaatggtttgacctcttcggggttgctttagtcgttgggattgcgattgcatctggttacctcaactcccgcctcgataaattcgtagactggggaccatggacagctcttgtaccctttggattgatttccgtaaccaacgttgggatttccatgttgtccactcgtttcacggggaaattaagcaaatggggaaattactttggtattgttaataccattttgtccggtgctattgattatatccttggaaataaggcggccatcatcacctatcccgtcaccttcctcatttatacctttgctattaagaaatgggaagcttcgcaagaaggcagacccaaccaaatgagccaaaaacagctaaaattggcggccatcatcatttccatcatcgccttcctctttgcctttgtgaccaactatatcggctatggaggaaagatgaatctccttgcctacgtaacaactattgcctttgcactgtccctcattgccaatgcttttaacgcattgaaactaacaactcagtggggcttttggttgatttacaatttcgttcagctgacaaaagctggtattcaaggaaattttgccaatatcggaaaatacatcttttatatcctcaatgcaatcggagctttatttgtctggaatgatgaagaagtaagataatagaagaaaacttaaataaaaaaacaagtcgacttaagagaatctcccttctgctatttttatcattttacttgtaactcccattcttttggagtagaatgaagttagataaaagagggaggtcatcttatgaaaaatctctttagaatccattttacagcaattgcagttatcgatttgctactattcgcattttttaacaaaagacccgagacatctttggagtggctcttgctatctggttttattttcctccttactcaaggactcctgttatttcgcttggttgtccgactcaaacatcaattcgctgagatttatcctcaaatcaataaaaagattcgcttctactatttaggggtgctcatcagcgactttctattttttgtccttttagccttcgttagttctcatcgtttttcatctcttatgccaatcatcactgcttgccattctactttttattatatgacagctgaccacctaagagaaaactatccagatttttacgacaaacacatctctttatgggagtgtctataaggaaaaggaggttttagcatgaaaaaaatcatcttcatcaaaaccattcaactccttgtcattgatggaatcatgctggcattcttgacatttaaagagggacttacttgggattggattttgatttatagcggttggctcattttctttcatcctgtgctattgacctatctttccaaccaactttgtgaccactttagtcacctttattcccagattagaccgagattctggcgttttgccttacaaatcctcctatgggatagcctgatcattctctccttgctgattgtaaggggtatcccacttttccttcagggaactctcctcatcctaggacatctcgtcccttcctatcgcatctgccaaagcctgaaacaagatttccccaaggcctatcaagaaccgatttcattttggaatattttatgatagataagaaaaaccaagccagctgggcttggtctttcttatctatttttagtatcaaggataatggtgactggtccgtcattgaccagctcaacctgcatatccgctccaaagatccctgtctgaacgggtacttcttgcgctaatttttgattgaaagcatcatagaagtctgatgccatatcaggcttggctgcgcctgtaaaggctggacgatttcctttcttagtatccgcaaagagggtaaactgagaaatagagaggatttctccttcaatatctttgacagacaggttcatcttgccttctgcgtctgaaaaaatccgcatattgaccagttttctcacagcatagtccaaatcttcctcttggtcctctggtccaacaccaaccagcaataagagtccctgattgattttcccctgaacctgaccttcgatactcacttgggcttttttaacccgttggataatgattttcataatagcctttctagtaagagctagggcaattaaccgttagtccgtttgacagagtaaacttctggcacactcttaatcttatccacgaccgaagtcagcgtcgagaggttggcaatgccaaaggatacatggatattagcaaacttcatatccttggttggttgagcgttaacagttgagatattcttggttgtgtttgaaagaacttgcagtacatcgttcaacagtcctgtacggttgagaccatagatatcgatatgagccatatactccttatttgagtttgaatactggtcttcccactccacatcaaggagacgttgctcgtagttttcttgggcacgcaggttcatacagtccacacggtgaatagccacaccacgacccttggtaatgtagccgacaatatcatcgccaggaacaggattacaacacttggcaatccgcactaggagacctgaggcaccttcaatgaccactccaccctcatgcttaaccttgagggtttctttgttctcaaccttgatctcgccacctttgacaagctctttagcaaattcaaatttactttccaagagaaatcttcccttcccctttttccttggcagtctgaactgctcgataaagcgaatagccactaactgtttcaaattctcgtcccaaacgtttttcttcgctcttgcttggcacgaccgctttgaatcccttataggagtccagtaactttttagcctctaccttgccttcataggcagcttcaacatcattaaaaaaagaaagcactgaagcaagttcttcagtgctccacgacaaatctagtgggtaactatactgtttgttcattaactaataccagctctcattcttgcttcttttagttcttgcttacggtaactacgagggagaaaagcacgaatctcatcttcattaaaaccgatctgcatacgtttggcatcgataataattggacgacgcaaaagacttggatactgctcaatcaaatgaagcaattctgataccgaaatactttctacatcaatatctaatttttgaaaaatttttgaacgagttgaaatgatgtcatcagtaccattttcggtcaaggaaaggatgtgttgcaattcttttcttgttaaaggactggtcataatattgtgttcctcaaagggaaccttatgtttttctaaccaggcctttgccttacgacatgaagtacagctcggtgatagaaatagtgtaatcatgcttttctcttcttatctatactttgctacttctattatacaaaaaaataaagcgcttgactagagatttt

SEQ ID NO: 67 - DNA, 164416 bp, Streptococcus mitis NCTC 12261 contig13
  misc_feature (162380)..(162380): n is a, c, g, or t
tactttttcatcgtttaaagcctctttagcttgatccaagtctttgtatgttttgacactgacatgctctaagtcatccatcctacttaccaaactacttggcacatcttgtatcgctagcttaacagtcaccgttgtactagccgaaaacatgaggttcatcagccacataataaagactggtgccacaaacattagggccagtgtccgtttgtcacgtagcaattctttgatgactttttttgcaatggcaattgttctcatttcattctccttctgctttcaaaaagacttcttcaatacttgaaacaccataagattcttttagcttggatggtgtatcaaaggctatgatttttccacctaatagtagaccgaccttatctgtcagctctgcctcatccatgacgtgagttgtgaccaaaatccctacacccttgtctctatgcgccatcaactctcgccagattttctttcgaagagaagggtcgattccaaccgtcggttcgtccaaaatcaagagttgagggtttcctaaaagcgcaatagccagcgacaagcgtcgtttcatccctccggaataaccagacacggccttatttaaatgatctgtcaagtctaccacttgagccacatgggtaatttcagctgtcaaatcttttttaggaatcccttttagctggccgaaaaattccaagttttcttgtcctgacaaagcctcataaagagcatctgactgggccatatagccaatatctcccagaatatgacgattgggcatggtctggtctaagactaaagcgataccgctatctgccttttccatccctaacatggttttaatcatggttgatttaccagcaccagaaggaccgattagaccaatgatttccccagactgtaattcaaaaccaacgtggtttaacacaagttgttgaccaaaagatttttgtaaatcttgtaaatgtagcaatgttttcatttacttcctcctaggtgagcgagcacttacttttttaaagataaatctattatagtgagtgaatactcacttgtcaagtgatgatttgaatttttttaaaacaaaaaatctccccgtagggagaatatctggtttattttaccttacagtgctaggaaccgtaacctaagattatacttgagcataccaaggtaaggtgacaacgtaaaaagccctctgaaaatcagagagctccagtcttgctggataaaccgtttatagactaggcgacgaggcgaagattgtacaaaatttttagtgaaacaaaaaaatctccccgtagggagaatatctggtttattttaccttacagtgctaggaaccgtaaccaaagataatacttgagcatatcaaggtaaggtgacaacgtaaaaagccctctgaaaatcagagagctacagtcttgctggataaaccgtttatagactaggcgacgaggcgaagattgtacaaaatttttagtgaaacaaaaaaatctccccgaagggagatcattctggtttattttaccttacagtgctaggaaccgtaaccgaagataatacttgagtatatcgaggtaaggtgacaacgcaatgtaagtggaaaataaagcagattaacgacgaagtcctagagagttgatcaactcacggtaacggttaacgtcgtttttacgcaagtatgcaagcaagttacgacggcgaccgatttttttcatcaatccacggtaagtagcgtggtcttttttgtgttgtttgatgtgttcgttaaggtggttgatttcccaagtaaggacagcaacttgaacctctactgaacctgtatcaccttcgtgacgtgcatattgtgcgatgatttcattttttttctcttttgagattgccatgatgtttctcctttttatttggcttcatccgagtgacaggttggcatgcctgtaaccaagaagaagttatttgtctttacgacaatccctattctaccaataactaacttctttgtcaacagatttactttcttgttttaaagatgctataataatcatagcaagaaatctaagttatctgttttttaaaacgaggtgattatcatgcgtagattctatttccatctcccctactatctggtcatatttttcttttattggccactttatgagttgttcttgctagttgtttctgaccccctcacactcaagggactctatataaacaatcttctcttctttacacctctggtaatcttgattatatcgctactctatagctaccgtttccgtttctcactttggtggttaattggtaacggactgctcttttgctttactatcataacttttggtgagtttatactaatttacttgctaatctatgaaaccttggctctggtgggcatggcttccggtattggcatcaagcatattctacaaaaatgaaaaacaaaaaactttcacaaaatccttgaaaaatctcacaatcatgctataataatccatagagacaagtcacttagtccctttctactagagagtgcgtggttgctggaaacgcataggaagtctaaactgatactactcttgagtttttatgaaaacataaaacggtggccacgttagagccaatcagaggtgtccctcttttttgaggaacataaatgaaggtggaaccacgttacgacgtcctttttaggatgtcgctttttgtttttctagctttcacaatcctctgtccctgttttcagaatagggttaacacattcgtcaataatataagtaaggagaacatcatgattaacattactttcccagacggcgctgttcgtgaattcgaatctggcgttacaacttttgaaattgcccaatctatcagcaattccctagctaaaaaggccttggctggtaaattcaacggcaaactcatcgacactactcgcgctatcactgaagatggaagcatcgaaattgtgacacctgaccacgaagatgcccttccaatcttgcgtcactcagctgctcacttgttcgcccaagcagctcgtcgtcttttcccagacattcacttgggagttggtccagccatcgaagatggtttctactatgatactgacaacactgctggtcaaatctctaacgaagaccttcctcgtatcgaagaagaaatgcaaaaaatcgtcaaagaaaacttcccatcaattcgtgaagaagtgactaaagacgaggcacgtgaaatcttcaagaacgacccttacaaattagaattgattgaagaacactcagaagacgaaggtggtttgaccatctaccgtcagggtgaatacgtggacctttgccgtggtcctcacgtcccatcaacaggccgtatccaaatcttccaccttcttaacgtagctggtgcttactggcgtggaaatagcgacaacgctatgatgcaacgtatctatggtacagcttggtttgacaagaaagacttgaaaagctaccttcaaatgcgtgaagaagccaaagaacgtgaccaccgtaaacttggtaaagagcttgatttattcatgatttctcaagaggttggtcaagggcttccattctggttgccaaatggtgcgactattcgtcgtgagttggaacgctacatcgtagacaaagagctagcttctggctaccaacacgtctacactccaccacttgcttctgttgagctttacaagacttctggtcactgggatcattatcaagaagacatgttcccaactatggacatgggtgacggggaagaatttgtccttcgtccaatgaactgcccgcaccacatccaagttttcaaacaccatgttcactcttaccgtgagttgccaatccgtatcgctgaaatcggtatgatgcaccgttatgaaaaatctggtgccctcactggtcttcaacgtgtacgtgaaatgtcactcaacgacggtcacctcttcgttactccagaacaaatccaagaagaattccaacgtgcccttcagttgattatcgatgtttatgaagatttcaacttgactgaataccgcttccgcctctctcttcgtgaccctcaagatactcataagtactttgataacgatgagatgtgggaaaatgcccaaactatgcttcgtgcagctcttgatgaaatgggtgtggattactttgaagccgaaggtgaagcagccttctacggaccaaaattggatattcaagttaaaaccgctcttggaaaagaagaaactctttctactatccagcttgacttcttgcttccagaacgcttcgaccttaaatacatcggagctgatggcgaagagcaccgtccagttatgattcaccgtggtgttatttcaactatggaacgcttcactgctatcttgattgagaactacaagggtgccttcccaacatggcttgcaccacaccaagtaaccctcatcccagtatctaacgaaaaacacgtagactacgcatgggaagtagctaagaaactccgtgaccgtggtgtccgtgcagacgtagatgagcgcaatgaaaaaatgcagttcaagatccgtgcttcacaaacaagcaagattccttaccaattgattgttggggacaaggaaatggaagacggaactgttaacgttcgtcgctatggccaaaaagaaacacaaactgtctcagttgatgactttgttcaagctatccttgctgatatcgccaacaaatcacgcgttgagaaataagagataaaacctgggataaaatcctagctacctaaaaagcaacaactatttcagctgttgctttttatattttatttaacctgagctagtagtgattgatcaaaccaccacacaagatttgctttcatgagttagatatggtcaatatcctcaatccttgtctgcttcattttcttttacgagatctttttgtgaatccttttcagagagtttttgatcgatatacttgttaatggtttcataaaattccttggtcgaatcactgtctaattttgtcgaattatgaacttgattgactttcaattgaacagattgaataccgtaagaggcttgtttttggtggagcgtttctaattcttcttctgaaagcggatctccaacaaccgtcaagaccaactcattgtttcttgatttgtagacttgattaatgaccgtgtgattggcgaactcttttcctacaaactgtttgattccttcttttcgcgcttgatctatcgttagagtgactgctgaatagctggccggaagaatcaataatacaatcaaggatatcaacccaattctcattttaatgtttagctctttaaatgaacttaagggagattttctcatcataattcttgttccaacaatgttgattagcatgataaagacacagttgatcaagaaaagatagagagccccaaataaaaatcgtacatttccattagctaaaccgtaacctgcagtgcagataggtggcatcagagctgttgcgatggctactcctggtacgatattgtttgcttcttttttccttgaaccaatgaaacctgctatcccaccagcaatagcaatgagcacatcccaaattgttggagaggttcgtgcaatcaattcgctactttcataagataagggagaaatccagaaatacagagccgagacaagcaagctaaccaatacttgggtaaataaaacctctagagattgcttgattaaacgcgtatcaaaaatagctaaaccaaatccgagtccaacaatcggtgtcataagaggggaaatcagcatggctccaataatgacagctgttgaattcatatttaggccaatagaggcaataaaaatcgcacacatcaaaatcactgtatctcttaatcgaacatgaagatcatcatataatttctcacggtattcacgtgttgaatagtttccggtcattggttactccttttatttcatataatcttgtttctgcatagatgatggtagagagacttctgtccaatcttacatatttttcttctcacctattattcttttgaaaataatcctctaagtatccgtcagtccatccttaacattatatcaaaaattttacagtctttctctgaggaaatctctcaatttaacagatagatgaagcaagaaatttttgtttccttatccgaagaaggaaaaacgatatctcctgaaccttgatactatgcgttttattctttataatttagctatttcaaaattacaagttctccattcttaatttcccaaacttggtcaaacttacttaataattcgttttggcgatgtaaagtaacaatgacggcacttggtagttccagaactctttccaattccattttaaactgattagtatccaaggcagagaaaggttcgtctaggataagcaatggatttttacgatttttctcacgatttaaatacattcgttgttgctgaccacctgacagggattgtggtggaattttttcaaaatcttcttctctgaatttttcattgaaactattgaatagcgttacattattttcataacttgaaataaatgtatgttcttgttgcagaatcataccgaatcttccccaaagatggtccaaaacaagcccatctagcacaatttgtccttcaaaatcttcatctgttccatttaaaatgttgagaagactactttttccagacccattcttaccaataagcgcaattttatcccctttttgaatcgtagcggaagtaattatcaattttgattctcccatttgtttggaaatgtttttcaaagtaatcgtatcaaaagaatgttgaggtgcttgaactgaaacgggtctcccaacaatgttttgaaaactcttgattacaggctttacggactctaacatttgtaaatcataaaggatttcctgtattggttcagaaaaagcattaatatatccgaaactcgccaccacctcaggaataccgagttgctggtgagatagagagtaggctaaataaataaacagaacaagactaatgaattcaaaagaaacacctgtcaataagatgccagtaatttttgtcaaaccatacttaaaatacttatcctgcaaattctttagagaactcttttgttgattcaaaaaatgcgacatagttagtttatttaccaaatgatgtcccatgagcaaatcctccaaagttcgatagtaatctccttgttttttcaagtaaacctgtctgcgattagcggtcaacttcccaacgattttaggaatttgaatactaattccagtggaaaagattaaaatcaatgatacaataggattaattgttctgctaataatgaaagcgtaaatgatgatacgtaaaatttgtttgataaaactcatcaatggaggaaggtaatccttttccaacgaatctaggtcattagattgataggaaatatactctgctactgttttctgcttgaaatcgtggtgactgagtcccagaagtgaacgaaaccactcatttttcaaagtagtcgaaaagataatcccctgcttccaatcaagtatcatttggatatagttacaactcaaatagccagccactgacatagagtaaccatatagagctacttgataatcccctttgattaatgcctgcgtgaaatacggtaacaaagctgtgcagatattcgatactacaccaaaaagaaaattaaagaagagataccatctaatagttttaagatatggtagcatatacgatactccttactaatgcgtttttttacatatcgcagaacaatctctactattccctatttcagatagtgcgatactcggacattgagtgcaataattgtaaatcacacaagtactgcagtttttactatcattcaaaataaaaagaaagctgcagttcttttaatcctgtatcaacgattcattctgaaatcgaataggagacatttcccaagtctacaattcacttcatctcaaattaatttctgtaattcacccttagtttatagattttatactcaacaaaagtataaagcatacaaaacttcactttgaaccagtatttatactatattccgtattaaaaattctattattggttttgaaaaaaacagtcttcaaatatcctgaaatatagcaaaaagagattgggtaaaaactcattgtctcttctcactcaaggactaagttcacttgagcaaactgaatccgcactgtcgttccttttccgacctcagactcgatgcgaatctggtgccccagttcttcagaaattttcttagataggtagaggccaagtccagatgactgctgggttaggcgtccattatatcctgaaaagccacgttcaaagactcggaggacatcactgttttttatcccgattcccgtatccttgatacaaagctcttgcccctccatataaatctccagaccaccttccttggtgtacttgagacagtttgagatgatttgctcaataaccactagcagccactttttatccgtcacgatttctttatcaaggtcatgtagattgacatttaagcctttttgaataaagaaaagagcatatttacgaattatttccttgaccaaatcctcaatttgcacctgctttaagaccaaatcatcatgaaaactttctaaacgcaggtactgtaagactagattagtataggagtcgattttgaaaatttcctgttctaattgctgcttcagttggcggtcggctacttctgcaactaagagttgactagctgcaatgggggtcttaatctgatgaacccacaaggtatagtaatccagcaaatccgtcaattttctttctgaatctgacctctgctgataaagttccatctcacgcgcttctaatttttctgctaaaactatttccaaaggagatttggcttccctctccccatagagaatttcctgacgatagacctgcatttccaccaatatgtcccaagtgaaaaataagatggttacaaagcaacacaagaggaaaaagtagagaaagtaaattcccaaactggcaaataaaaactgaaagagtaagagcagaaacgtcaaagaaatcagatagacaaacagacgactacgggaacgcagataggctagaaaaaattgtttccaatcaagcatgctttaatccgtaccctatccctttcttggtttcgataaatcctaccaagccctgctcttccaactttttacgcaatcgagccacattaacagatagggtattgtcatcaatgaaaaagtcactgttccaaagttcccgcatgagatcgtcacgcgctacaatattgcccgcatgctcaaacaaaactcgtaaaatctggaattcgttcttggtcaaattcaagacttgcccttgataatgtaaatccattgatttggtattgaggataacaccagcatattccagtaaactctcgtcacgcccaaactcatatgaacgtcgcaacaagccctgaactttggctaaaagaacctgctggtcaaaaggcttggtcacaaagtcatccgcccccatattgattgccatgacaatatccatagcctggtctctcgaagacagaaacatgatggggaccttggaaatcttgcgaatttcctgacaccagtgatagccattaaacaagggcagtccaatatccatgaggaccagatgaggctccgactggacaaaaagactcaaaacttccataaagtcttctaccagcaccacttcaaatccccattcagagagcattttcccgacctgttgacgaataacctgatcatcttctactaataaaatcttgtgcatgcgctcctccttttctattattataacagatttttcaatgctagaagatctgaaactgaatttgaagcagcttgtttttaggcaacaaaatgaggcaatcctactagctaatttaagggaaatttgataagataaataaaaagaaaggagctcttatggccaatatttttgactatctgaaagatgtcgcacacgattccttttacgacctacctttgaatgaattagatgttttagccttaacagaaaccacctacctctcctttgataatctggtctccacaactcctcagcgacttttagacctggcacctcaggttccaagagagcctaacatgttgaccagcaaaaatcgcctccagctattggatgaattagctcgacacaaacgcttcaaaaattgcaaactctcccattttatcaatgacatcaatcctgaattgcaaaaacaatttgcagctatgacctaccacctcaatctcgatacctatctgattgtctttcgtgggactgatgacagtatcattggctggaaggaagatttccacctgacttatatgaaggaaattcctgctcaaaagcatgccctccgctatttaaagaacttttttgcccaccatcctaagcaaaaggtcattctggctggacattccaagggaggaaatttagccatctatgctgctagtcaaattgagaaaaacttgcaaaatcaaatcacagcagtttatacctttgatgcgcctggtctccacacagaattgacacaaaccgagggctatcaaaggataatggataaaaccaaggtcttcattccacaaggttccatcatcggtatgatgctagaaatccctaaccagcaaatcatcgtgcacagtactgctttgggtggtatcgcccagcacgatacctttagttggcagattgaggacaagcacttcgtccaactggataaaaccaacagtgatagccaacaagttgacataaccttcaaagaatgggtggccacagtccctgacgaggaactccagctctacttcgatctcttctttggcaccattcttgattctggtattacttctatcaatgacttgtcttccttaaaggctatcgaacacattcatcatctcttcgtccaagctcaatccctaactccagaagaaagggaaactatgggacgtctcactcaattattgattgatacccgttaccaagcatggaaaaatagatagtactcttgaaaatcaaatgtatacaaaacaaaagacctagaatacatactttcatgtgcattctaagtctttttaaatagaatctgactaccaaataattcctttgtaggctatcaaaatgagtgctaatagcaggacataaaaggcaaggaaaagccatttcattttgacacagagagctacgtactcccgaataaaagcagatggtatgtagtagcctgccgtcctacatccgaggccatctcccttcatttttaacttacgagcataggtacttgttctaaagacatgataatcatttgttacaaagaggaattgaggtttggctaccagcttctcaccaagttccttagaaaagagaaggttctcgtaggtagtccttgattggtcctccaggataatcccatcttggggaacatcggtctcttcaagcagatagtttgtaatagcctgcgcttcagaaatcttctcatctcctccttgaccaccactagcaatgattttgatatgaggattcttagaattgtggtaagcttctactgccttatcaattctcctctttagcaaaggtgttaccttttctccgtctaacaaacctgcaccatgaatgatgataaaatcataatgcttcttcttaggaataaagagatacaagatagagtacaacataaaacccacaaaagcaaaaccaaaaataaagtaagaataagcaataaatgcaaataaaatgtttagaaagtgattggtgtaaaataattcatttctatcacccaatcgaaatgacatcaaggcaaaaaataacaaaatgactattccaaggagcattgagagataattagcctttgaacgtccctctcgcttcagcaagataaggccattatagattaaaaagatgccacttagaaaaagcagtatcggaagtaaaataaagggaaatataaaaaaagcgaaatgaatcttctcatacccattttgataaaaaaggtagcctagataaaaataactggaaatgagggataataagaataatactggattccacaaacttctattatctttccaaaatgacactataaaggctaatacaattcctataacaagatacatttcttcctcctttaatgattctattttatcacaattttacatagagaaaaagagggcatctacccctctcactccttcatttgactctctgcatcggctacgacctgttctagactggtctgaccaagctcagcctccatagccagctggattctctccaatttttgatccaaaacatcatgaatatgagctccaactgggcaatttggatttggattgtcatgaaaactgaagagttggcctgtcttaccaagacattcgaccgcttgataaacatctaaaagactaatgtctttgagatccttaacaatctctgttccgcccgttccgcgcgcgactgaaatcagctctgccttcttcaactgggacaaggtctttctgataatgactggattgaccccgacactagcagccagaaaatcactggtcaccttgctttccttcccctcgagggcaataattatcagcatatgagtcgcaatggtaaatctacttggaatttgcatcctcttctcctttttacgaggctaccctgcctctactcttctttttctattattataccctttttagttgtaatgtcaatcgttaccacttttcaaccaagcatctaattccctatcatagccctctttctgggctaattctctcagaaattcctgatgatgagtatggtggataccattgaccagactttcatagtaaacctcaaaatagggaagtttgaggtctttagctagctgcaattcagctgccacatcgtagtccacccgtcggaagtccatatctaccaagcccttgtcatcaaactccaaaatcatatactgggcccgtaagtccttccgcaactgggcatctagaaagaaaggttgcccaatcgaacctggattgacaatcaattgcccaccagtcccgtaacgaagcaactgctggtggatatgaccatagacagcaatatcacaaggcggattggtcaccaagcggtcaaaatcctcttgttctccagtgtgaatcaactctctcccccagttcttatcaggaagatgatggctaattcccaccgtcaaatccccaaactgacgatgaatctggagaggttgattgtggagcagttcaatttcttctagggaaatttcctctaaaacatactgacactggcgcaagagatagcgttgactgggacgagtactatccaattccttgcggacaccatgccacaaactgtcttcccagtttcccaaaactctagccgtaatcggtagttgagccaacaagtccaaaatccttctacgccctgtccctggcatgagaatgtctcccaaaagccagtattcatccactcctagctgccgcgcatctgctaaaactgcctctaaagcagtggtattaccatgaatatctgaaagaagagctattttcgtcatatccatctcctcgttttttctcttgcaataagtataacataaaaagtcacagctagagaaatctagctttttttgatatactagatatagatattagacaagaggaagcgaatgaccccgaataaagaagactatctaaaatgtatttatgaaattggcatagatttgcataaaatcaccaacaaggaaattgcggctcgcatgcaagtctctccccctgccgtaactgaaatgattaaacggatgaagagcgaaaacctcatccttaaggacaaggaatgtggctatctactgactgacctcggcctcaaattggtctctgagctctatcgtaagcatcgcttgattgaagtttttctagtccatcatttagactatacaagtgaccagattcacgaggaagctgaggtcttggaacatactgtctctgacctgttcgtggaaagactggataaattgctaggatttcccaagacctgtcctcatggaggaactattcctgtcaagggagaactcttagttgaaatcaataacctgccactagctgatatcaaggaagctggcgcctaccgcctgactcgggtgcacgatagttttgacattctccattatctggataagcactcacttcgcatcggtgatccgctccaagtcaagcagtttgatggcttcagtaacacctttactatccttagtaaagacgaggatttacaagtgaatatggacattgcaaaacaactctatgtcgagaaaatcaactaatttctcaagtcccccaaccaaccctgaaagttttattttcagggttttatttctatcatttgattttgctttcatttaattgtagaatatttgtaaaaaaaagaaagatagtttaaactatgaaaaaatcactaaaaatttttgctacatctaaatggtttgacctcttcggggttgctttagtcgttgggattgcgattgcatctggttacctcaactcccgcctcgataaattcgtagactggggaccatggacagctcttgtaccctttggattgatttccgtaaccaacgttgggatttccatgttgtccactcgtttcacggggaaattaagcaaatggggaaattactttggtattgttaataccattttgtccggtgctattgattatatccttggaaataaggcggccatcatcacctatcccgtcaccttcctcatttatacctttgctattaagaaatgggaagcttcgcaagaaggcagacccaaccaaatgagccaaaaacagctaaaattggcggccatcatcatttccatcatcgccttcctctttgcctttgtgaccaactatatcggctatggaggaaagatgaatctccttgcctacgtaacaactattgcctttgcactgtccctcattgccaatgcttttaacgcattgaaactaacaactcagtggggcttttggttgatttacaatttcgttcagctgacaaaagctggtattcaaggaaattttgccaatatcggaaaatacatcttttatatcctcaatgcaatcggagctttatttgtctggaatgatgaagaagtaagataatagaagaaaacttaaataaaaaaacaagtcgacttaagagaatctcccttctgctatttttatcattttacttgtaactcccattcttttggagtagaatgaagttagataaaagagggaggtcatcttatgaaaaatctctttagaatccattttacagcaattgcagttatcgatttgctactattcgcattttttaacaaaagacccgagacatctttggagtggctcttgctatctggttttattttcctccttactcaaggactcctgttatttcgcttggttgtccgactcaaacatcaattcgctgagatttatcctcaaatcaataaaaagattcgcttctactatttaggggtgctcatcagcgactttctattttttgtccttttagccttcgttagttctcatcgtttttcatctcttatgccaatcatcactgcttgccattctactttttattatatgacagctgaccacctaagagaaaactatccagatttttacgacaaacacatctctttatgggagtgtctataaggaaaaggaggttttagcatgaaaaaaatcatcttcatcaaaaccattcaactccttgtcattgatggaatcatgctggcattcttgacatttaaagagggacttacttgggattggattttgatttatagcggttggctcattttctttcatcctgtgctattgacctatctttccaaccaactttgtgaccactttagtcacctttattcccagattagaccgagattctggcgttttgccttacaaatcctcctatgggatagcctgatcattctctccttgctgattgtaaggggtatcccacttttccttcagggaactctcctcatcctaggacatctcgtcccttcctatcgcatctgccaaagcctgaaacaagatttccccaaggcctatcaagaaccgatttcattttggaatattttatgatagataagaaaaaccaagccagctgggcttggtctttcttatctatttttagtatcaaggataatggtgactggtccgtcattgaccagctcaacctgcatatccgctccaaagatccctgtctgaacgggtacttcttgcgctaatttttgattgaaagcatcatagaagtctgatgccatatcaggcttggctgcgcctgtaaaggctggacgatttcctttcttagtatccgcaaagagggtaaactgagaaatagagaggatttctccttcaatatctttgacagacaggttcatcttgccttctgcgtctgaaaaaatccgcatattgaccagttttctcacagcatagtccaaatcttcctcttggtcctctggtccaacaccaaccagcaataagagtccctgattgattttcccctgaacctgaccttcgatactcacttgggcttttttaacccgtttggataatgattttcataatagcctttctagtaagagctagggcaattaaccgttagtccgtttgacagagtaaacttctggcacactcttaatcttatccacgaccgaagtcagcgtcgagaggttggcaatgccaaaggatacatggatattagcaaacttcatatccttggttggttgagcgttaacagttgagatattcttggttgtgtttgaaagaacttgcagtacatcgttcaacagtcctgtacggttgagaccatagatatcgatatgagccatatactccttatttgagtttgaatactggtcttcccactccacatcaaggagacgttgctcgtagttttcttgggcacgcaggttcatacagtccacacggtgaatagccacaccacgacccttggtaatgtagccgacaatatcatcgccaggaacaggattacaacacttggcaatccgcactaggagacctgaggcaccttcaatgaccactccaccctcatgcttaaccttgagggtttctttgttctcaaccttgatctcgccacctttgacaagctcttctgcttccgccttggccttggcacgttcttcttcacggcgttccttttcagtcagacggttaaagacagtaatagcaccgatttctccaaaaccaatggctgcaaagagggattcttctgtcttgtagctggtcttttgcagaacttggtccatatgacgcttgtccatgaatttattggccatatagccattttcttggaactgagccatcagcatttcacgacccttgttgacagacaattccttatcttgatttttaaagaactgacggatcttgttgcgggccttgctggtcttgaccatattgagccagtcacggctaggtccaaaggagttcgggttggtgacaatttcaacctgatcccctgtcttgagcttagttgtcagaggaaccatacggccattgaccttggcacccgtcgctttttcaccgacttttgtatggatttcgtaggcaaagtcaatcggtcctgaatcttttggaagggaacggacagctccatctggggtaaagacataaatctcctcagccagatagttttccttaactgaatcgacaaattccttggcatcatcagcctggtcttggagctccatcatctccttgatccagttcatcccaatagctgattccttgctgttaacctgccccttgatgcccttcttataagcccagtgagccgcaaccccgtactcagccacctcgtgcatttccttggtccgaatctggaattcaatcggcccttttggcccatagacagtcgtatggatagactgataaccattggccttgcggttagcgatatagtctttgaaacgacctggcattggtttccaaagttcatgcacataaccaagcatggcataaacatcactttgggtatctaaaatacaacgaatagcaatcaggtcatagatttcctcaaaacgttttctcttatcctgcattttgcggaaaatcgagtaaatatgcttgggacgaccataaatcttcccttttaagtgacgatctgtcgtatattcctctaattttgtgactacctcatccaccaaggcttcacgctctctgcgcttttccttcatcatatgggtaatcttgtaaaactccgttgggttgagataacggaaagacaggtcttccaattcccatttaacgctagaaatccccaaacggtgagcaagtggtgcatagatttccatggtttctttggaaatgcgctcctgcttgtcttttcgaaggtgtttcagggtccgcatattgtgcaagcggtcagacagtttgaccaagataacacggatgtcctcagacatggccatgagcatcttgcgatgattttcagccaactgctcttcgtgagacttgtacttgaccttaccgagcttggtaactccatcgacaatcacgcgcacatcaggaccaaactctctttccaaatcgtccaaggtcgcatcagtatcttccaccacatcatgcaagaaaccacaagctactgttacagcatccaacttgagtttggctaaaatacctgccacttggatagggtgaatgatataaggctcgcctgatttgcgatactggccactgtggcattcaacggcgtaaaccaaggccttatggacaaaagccacatcttcttcccgataaatatttctgtgttaaagcgacaacttcatcgcctgttaaattcacttcttttggcatctctactctccaattcttcctaccattttatcacttttttaagaatatgaaaactagaaaaagaggattctgaagctattcaatttgttgggatggatgatagaataagattcaaacttaaaaaataaaattatctgattttcatctaacttttttgaaatatagtctacgctaaaagttagtgaaataaaaatcttttcttctgtttaaataagaaaaggtttgatattttggtaattttctaacatttttagtgtataatggtaatataaacagtttttttacgatgattactgaattttcatttttctagaaaggcaaacaacatgaaatcacacaaaagactgacacttttagccttggcttttcttggactaacaaaccaagtcgttttggctgatgatactagtcattccgctactaaccctatgactagttcaactagtagctcaacaaatacttccactagtcattctactaacagttctacaaatacttctgctagtagttctcaagctagtacagaaacttcgtcgagcacagctagttcaagtgagcaagaaagcaaaccttctctttccacagaaaccaaacccaatcaacctatacaaactggctgggtaaaagaggggaacaagtggactttttatagtcaaactggggtcaaatttacagataccctctatgaaggttatttctttgatagtcatggctacttgcttgaaaacagctggtaccaaatgggaaacaattggtactatatcaatggttcaggtaaatatttatccaaccaatggagccaaatcaatggcaagtggtatgcttttgatggctatggtagaatgttggccaatgtctggaaaggcgattactacctcaaatccagtggtgctatggcagatagggaatgggtctacgaccaaagctactctagttggttttacctaaaatctggcggacgctatgcccaaaaacaatggattggttcctactaccttaaatctggtggctacatggcccataaggaatggatctacgaccaagactatcaagcttggtactatcttaaggacgatggtgtgtatgtcacaggaacctatgcagttgatggtaaaaaccagctcttccaagggaatggaaaatgggttcgtgaattagcacaaggttttcaaaaaggacattactctaaaactatctttcttgatccaggtcacggtggtaaggatcgcggggcttattactatggcatagctgaaaaagaattgaacctacaagtttatcgtaagctacgtaaacgactagaaggactcggctataccgttctcacctctcgagatagtgatatagacgttaattttattaccgagcgttctcgtatggtcaacaagaccaatgctgactttttcatcagccttcatttcaatgcaaaagggaataatacaaccgttaatcttggcatccagacctattcttacaaggatgaacctggtttccctagcaagattaacaaggattggcacaacaatcctgaacggatgagtgaaagtaatcgtctcgcagctgatatccattcttcactgctagctgaaactggagctagggatgctgggctcttgcaagcaacctttgctgttctccgtgaaacagctaaaccagctgttttgctggagatgggatatatggataatccagaagaaaaccaaaaaatccgcagcagtgactaccaagataaactagttgaagggattatcaagggaatccaaaaatattatgctggtaattaaaacagtttaagcctcgaactaactcgaggcttattttttatccaaaccatcttcttctttctagaactatttcgcttttcagcttattcttcctaactgtgctatacttatcttagtacattctttgagattggagctaatatgaaaatccataaaaccgtgaatcctgttgcctatgaaaacacctattacctagaaggcgaaaagcacctcatcgttgtcgatcctggtagcgattgggacgctattcgtcagacaatagagaacatcaacaaaccgatctgcgctattctccttacccacgcccattatgaccatatcatgagtctggacttagttcgcgaaacttttggcaatcctcctgtctatatcgcagagagcgaagctagctggctctatactcctatcgataacctctctggtctccctcgtcatgatgatatgacagatgtgatcgcagaacctgctgaacacacctttgtctttcataaggaatatcaactggaggaatttcgtttcactgtcttgccaacaccagggcactctatcggcggtgtttctatcgtctttcctggtgctcacctagttttgacaggagatgccctattccgtgaaactattggacgaaccgaccttccaactggtagtacggagcaactcctccatagtatccagacccaactcttcaccctaccaaactatgatgtctatccagggcatggtccagctacgaccatcgcccatgaaaagacctttaatccttttttctagtaaaatgatgacaatgtctatcgcattttaagtacactatccagcaagtctttccactataaaaggcatccagtcaaggttttcacacctgattggatgccttttttctgatgactagattttttgcattaccaaataatcacacggtcttctggtgaacgccacattccgtccccttctttgacatcataggttgtaaagaagtcatcaaagtttggcacttggacattgacacgaagtttagctggcgcgtgtacgtcgacgctagccatgagtttcatcaactctggacgccctttcatacgccagatacgagcaaagttatggaagaactcttcagctgagaagtctggctctctcttagcagcttctagcgctgcagcaattcctccaaggtccgcaacgttttcggatacagttaatttcccattgatttttgcaccgtaagattcttgaccatcaaactggtcgataaccttctgtgttttttctttaaaggctgcatagtcgctttctgtccaccagtccttgaggctaccattttcatcaaaggaagcaccattagtatcaaaggcgtgagaaatttcatgggcaataaccgcaccaataccaccatagttggcagaagatgactgatgcaagtcatagaatggtgcctgtaagatagcagctgggaagacaatcaagttcttttgtggattgtagtaggcattgaccatatgagcaggcattccccactccttgtagtcaaccggctgattccacttgctccagctgtgcttaatttctacacgcgcaaatgctagagcattctcaaagaggctagcagattcgtctactaccttgtccttatagcgagctggcagttcttttgggtaaccaatataaggtttgataacgttgagtttgacgatagctttttctcgtgtttcaggtgtcagccagtcattcttagccaaacgttccttataaacgtcaatcatggtcgccacttttttctctacgtccgccttggcttctggagagaatttttcgtgggcataccaaagaccaagggcttgtttgaatggtccttgagctaagtggtaagctgccttgcgtttgtcttgagcctctggaactcctgaaagagctcgtccgtaggcacctgacaagatacgaatctcatctgtcaaatagctcgttgaaagattgactacacctaagatcaagcctgccttgagcaaaggccaagcttcttcactatagaattgctctgctgcttgccagaaacgttcctcgtctacgataaccttgtctggtgcttgtccaagaacatcttggaagaagtcatccaaaggtagggcaggcgcaaatttcttgaaatcttcgtaatcatatggatggtaaagtttagcatactctgaactttcttcattagagagcactactaccgcgattcgacggtccaattctagtcttttctcaagcaagtcttcaatttcttcatcagagaaatcataagccttgaggagatttgcgctagtttctttccaaagagtcaagagttcctctcgctgaggatggtcttcagaatagtaggtcgtatctggcaggattgtgcttggagcactggcccataaaacgttgattctggcatccataaagtctggtgatactccaaatggaaggaagtttggtttaccagctaattcaaatgctgctagtttacttgcgaaatccgcaaaactttctaaattctggtattccttcaataaaggaaggactggttcaattccatctgcttctcgcttatcgaaatctctgaccatactatggtacttgacaaaatttgccaagatagcatcctcaggcacctcttctcctgccaaccacttgtctgttgtcgccagcatcaggtcttcaatttcctggtctaaatcaacaaaacctccagtttaagacttatctgctgggatttcagctgttttctgccattccccattgattgcatcataaaaatcgtcttgataacgtgtcatcttgttctcgctttcatttgtacttgcttttagcttaacaaaaattacttgggaatgcaattaaaaatgaactgatattttctattgtttttcagttattattttaattttttcaaaaattaacttgacttaattttttttttaatgtatattaagaggcaggaggaatacaactgtatgatacgtatcgaaaacctcagtgtctcctacaaagaaacgttggcacttaaggatatttcactagtgctccaaggaccaacaattaccggtatcattggtccaaacggtgctgggaaatcaacattattaaaagggatgctgggaattatcccacatcaaggtcaggcatttctcgatgacaaggaagttaaaaaatccttacatcgaatcgcttatgtcgaacaaaaaatcaatatcgactacaactttcccatcaaggttaaggaatgtgtctcgctaggactctttccctctatccctctctttcgcagtttaaatgctaaaccattggaagaaagtgcaagaggcccttgaaatcgtcggtctagctgactacgctgaacgtcaaatcagtcaactatctggaggtcagttccagcgggtcttgattgccagatgtttggtgcaggaagctgactatatcctcttggatgaaccctttgttgggattgactctgtcagtgaggaaatcatcatgaatacgctgagagatctgaaaaaagctgggaagacggttctcatcgtccaccacgacctcagcaaggttccccactacttcgatcaagtcttgcttgtcaatcgagaagtgattgcctttggtccaaccaaagaaacctttaccgaagccaatcttaaagaagcttacggtaatcgactctttttcagtggaggtgacctatgattgcagaatttatcgatggattacaaaaattccatttcctacaaaatgccttgataacagccattgtcatcggggtcgtagctggagctgtgggatgtttcatcatcctacgcgggatgtcactcatgggagatgccatttcacatgctgtcttgccaggtgtagccctctcctttatcttgggccttgacttctttatcggagccattgtctttggactactagctgctatcatcattacctacatcaagggaaactcgattatcaaaagcgataccgccatcggcattaccttttcttctttcttagccctcggtatcatcttgattagtgtcgctaaaagttcaactgaccttttccatatcctttttggtaatatcctagccgtccaagatacggatatgtttattactatgggtgttggggcagtcattctcttgttaatctggattttcttcaagcaactcttgataacttcctttgatgaactcttggccaaagccatgggaatgcctgtcaatttctatcactaccttctcatggtactcttgactctcgtgtctgtgacagccatgcaaagtgtcggaactatcctaattgtagccatgctgattaccccagctgcaactgcttatctttatgctaatagcctgaaaagcatgattttcctttcctcaacctttggagctactgcttcagttttgggactctttatcggctatagtttaaacttagcagctggttctagcatcgtgctcacagctgctagcttcttcttaatcagtttctttatctctcctaaacaacgatatttgaaactgaaaaataaacatttgttaaaataaggggaaagcccccaataaattggaggatctaatgaaaaaattaggtacattattcgttctctttctttccgttattgttcttgtagcatgtgctagcggaaaaaaagatgcagcttctggtcaaaaactaaaagttgttgccacaaactcaatcatcgctgatattactaaaaatattgctggtgacaagattgatcttcacagtatcgttccgattggacaagacccacacgaatacgaaccactccctgaagatgttaagaaaacttctgaggctgacctcattttctataacggtatcaaccttgaaacaggtggcaatgcctggtttagcaaattggtagaaaatgccaagaagactgaaaacaaagactactttgcagtcagtgaaggtgttgatgttatctaccttgaaggaaaaaatgaaaaaggaaaagaagacccacacgcttggcttaaccttgaaaatggaattatctttgctaaaaatatcgccaaacaattgagcgccaaagaccctaacaacaaggaattctacgaaaaaaatctcaaagaatatactgataagttagacaaacttgataaagaaagtaaggataaatttaataacatccctgctgaaaagaaactcattgtaaccagcgaaggagcattcaaatacttctctaaagcctatggtgtcccaagtgcttacatctgggaaatcaatactgaagaagaaggaactcctgaacaaatcaagaccttggttgaaaaacttcgccaaacaaaagttccatcactctttgtagaatcaagtgtggatgaccgtccaatgaagactgtttcacaagacacaaacatcccaatctacgcacaaatctttactgactctatcgcagaacaaggtaaagaaggcgacagctactacaacatgatgaaatacaatcttgataagattgctgaaggattggcaaaataatactcttcgaaaatctcttcaaaccacgtcagcgttgccttgccgtactcaagtacagcctgtggctagcttcctagtttgctctttgattttcattgagtataagcctctgaaaaacgtcattctcacatgagctggcgtttttttctatgcccatatttccggtcaaatcattggaaaattccgactgtttcagctaaaatggaagaaaaaagattggagtatcttatggtaacttttctaggaaatcctgtgagctttacaggtaaacaactacaagtcggcgacaaggcacttgatttttcactcactacaacagacctttctaaaaaatctctggctgattttgatgggaagaaaaaagtcttgagtgtcgttccttctatcgatacaggcatctgctcaactcaaacacgtcgttttaatgaagaactggctggactggataataccgttgtcttgactgtttcaatggacctcccttttgcccaaaaacgttggtgcggtgctgaaggtattgaaaatgccatcatgctctcagactatttcgaccattcctttggacgtgattatgctctcttaatcaatgagtggcatctattggcacgcgcagtctttgtcctcgatactgacaatactattcgctacgttgaatacgtggacaatatcaactctgaaccaaactttgaagccacaattgcagctgctaaagccctatagaaaaaatcctctgtcacaaagagttccctactctttgaaacggaggattttttgtttacgagtaaatataagttcaatcagataaaagcaactaccttactctacagatttcaaggcttcaagcatatcaacctttctcagatgatgattgacgaagaaaccaagcaaggtcaaaatgatgcttactgctgccactgggattacatagacttcccagcctacctgcggataaaagagaatagtagcaggcgaaatcatttgaatcaaaaattgatgtaaatagaaaccagataccaaaccaagtacgattcccacaagggacagcacaatcgtctcacggtaaatgtagagggtgacttcattattatgaaagccaagaaccttgatagtggagagttcacggattctctcagctacgttgatattggtcagattgtaaaggataacaatagccaacagaaccgatacgatgaccaagatggtcatagtctgattgagtgagctagcgacggagtcaaagagtcgaatggctgaagcattttggacaacgctggacaccgcagcttgattcataagtaagcctgcctgcctttcaatactagtagcactggtatcccttagcataaccagataagtgttgacttggggtaactgtccgtaaatttgctcatagctagcctgactcatataaataaagtgaccaacgtagttctcagtaatggcagtgacctttagctccttaccttcaatttctagactctgcccaaccttgacacctgccaactgggctagtttagctgtgatgacaactccatcttttaatgtcaactcttgctgatggtcttgcagatggataaagggagtcaaatcctccttatctgtcatcataagagtaatggtttgaagaccagccttacctttgaaatccttgtctagcgtcttagaataaattttctgataggctttgatgtcctgccctttcaacacttcttctagatttaccttgtcctgattggtcgcactaggattttcagagacaatcatctgatactgttggatttgttgaaactgtttagacggaactcctgctacagaggattggattcccaaacctgcaaaaagcagagctacagaacctgccacaccaaagatcgtcatcaacatccgctgcttataacggaagatattgcgggctgttaccttatgagtaaaactgagacggcgccagataaaactgagacgttccagtaagattttggctcctttaacaggaggtttaggcagtaaaagctgggctgcttcatcgtgaagttccctccgagctaccaagtaggctggtaacacactcgccaaccaactcaagacaagagccagtaagctataggtccaatagaactgaatctgggtttttcccactaccataccttttgtaataacacttgaaatcacaccggctagtaaataatgtccaagtatgctacctagagccgttccgacagtcccagctactagaccgtaaaggagaaacttggcaataatatccttgctacgatagcccaaggccttaaaaatccctgcatgtgttcgctcttcatccacaaaacgagtcatagttgtgaaggtcaccatagccgctacggcataaagcactacaggaaagatattgcccactgcccgaatactggctgaagcattactgtacatgaggtagccttgaccgccaggcatggtttgccgattatagacttgatacttgggctccgccaaatcatccaagacttgctgatgtttttctaatttttccttttcttgggctaaattttgttcagcctgctttagtttatcctcttccttactcaattcctgcttagcttgggtaagttgagcactggcctgctctctctgagcttgaggcaacaaggctagttgactttcctgagcctgtaaacgagcttgagcagctgctaaacgacgcttggcttcctgcagattagtctcagccttatcaagggtctcttgccccttatcgatagattcttgcccttcttttttcaagaattgcagacgtttcttgccattatctgacaaagcttgttcaaggtcttcctgatgttgcttggatttctcttcataagctgatgaaaaagcatttaagcctgctaaatcttgatatttcaagcgtgctatattatagactttctgatcaaattggctaggcaaaatcaccccataggctgtcagagttccgcttccacttgctgcgtagcccatatctcgctgggagaggatttcagctgaatctacaaaaccagtaatggtataagtatgatcttttaaagaggaatgaccctcttctttttctttaaaactaatctcctgtcccacgctgtattggccttgcaaatgagtagccaaagcgatttccttgtctgactgaggaagtcgtccctctcttaactgaaaggttgaaattcgctctggtttagaatacagcctaatggcatcctgcccattatccatagtcacatctgtcaaatagccaaactcaacctctgcgccctctatctgttctaattcttcttgatctgcttgatccaaaccatagttagacatgactgccaaatccaaggtttgagcagttgttaaataagcattagctgttgcctccatgttggggctagtcactttgaggcctacaagggctagagaccctaacatcatcaaggtcaagatggataagaaacgccccttggagcctgtgaaggactgaattaagtccttccaataggtttttcgcttgatcatgctagtactccaaactgtcgatatcctgaggatgctggttcatcaccacatccttgacactggcatcgtgcatatgaatcacgcgatcagcaatgggcgccaaagctccattgtgagtcacgataatcaccgtcgctcccttttgacgagacatatcttggaggattttcaaaacctgcttgcccgtctgataatccaaggctccagttggttcgtcacaaaggagaattttaggatttttggctaccgcgcgtgcaatggagactctctgttgctcccctccagaaagctgggctggaaagttattgagacgatgagccagacctacatctgtcaagacctgttcaggattcaaggcatctgtcacgatttctgaagccaactccacattttccttagcggttagattggaaactagattataaaactgaaaaacaaagcctacatcattgcggcggtaattggtcctctggtgggaactatagtctgcaatattggcaccatcaatccagatttccccctcatcattggtatccattcccccaagaaggttaagaaccgttgacttgcctgcaccagatgcacctagaataataaccaattcacccttttcaatctcaaaattcacatcacgattggccacaatctccgtgtccccaacctgataacgcttgtaacagtgtttcatctcaatataagccatcagactcaccctctctcaaacaaattacttcctattaccattataacgctttttcaactagttggaaactgcttacattctcaaatccttattaaaaggcagtctcaaactactgccttctaacatcttcttaaaaataaaattgaaccagatcgccttctgctgttgctaccgaaatacaatctttctctatgcatttcacttttgctttttcttgattcacttcaaccacactattttcaatacctggataagaaactcgcaattctcccccacttcttgataaaatggtcaactgaaagagttttttatccgcccacctcatgctaatttcaaaatgtccacgtgccattaagcctgaaacggaacctgttgaccatgcatcgggtagggcggctagaggtaccagataagctgtatgagactggagcaacatttctgccatgccactgctagcaccaaaattaccatctatctgaaaaggagggtggctacaccaaagatttggcaaggtggatgactttaactgctctgctaataatttatgggctcggttgccatctcctagacgcgcccaaagattgatcttattagccttggaccagcctgtaccaccgtctccacgatcattgaggctagcacgcgccgattcaagatactcttgtcccttgtagctaaagagatttccaggatagagtcccactagatgggaagcgtgccgatgctgggcctccactttctcattttgaaaatgttgctcttcctcctcataccactccctgattcgaccagattgagtgatttgaagaggattaagcaagtcaaatttctccttgacctcagtcaacaagtccgcatccagctccaattcttgagcagcctgaataaaatcatggaataattgccaaataagagattggtcataggtattgccaatcgaaatcggcccatgttctggagaataagacggagaagagacccaacgctgcgcctgctgatcctcatgtaaaaaatcattccaaaaacgaaccgtttccctcaacatgggataaattttctccctgagatagtcttggtccctataaaatgaataggcttcataaaccgtttgcatcatccacgcattggcagctggtgaccaaccccaatagtaatcccaaccaggtgccgtccaaccaaagggagtcgcttgagtatgaaccaaccaaccattctcctccccttcctgagagacgattcctgcataccttgcagccgctagacgaccatagacacgcaaatcatctatatagttgatgactggaaaagccgtctctagaagattagtaacataggctggccaataattcatctgcagattgatattcaggtgatagtccgaattccaaggaggattatcgaccgcattccagactccctgtaggttagctggtagagcatctgagcaatctctagaagaactaatcaataaataccgtccatactggaagaacaattcctccaaagcatgcccctcttgtggcttataattttttagcaaattatctgtagtggatgtgtctacatcagctcccaaatccaattgaacacgttggaataaggcttggtaatcctgaatatgccttgatttcaattgggcatagcccttttctttagctatctccaccaagtccttaacctgtttctctaaatctattttcttgcgataattactagcaggattttgggcaaaatcagtcttagcagccaagaaaagattggcataactggctcctgatatctgagccttatctgaccaaactctaatatccccatctgtttcccaagctaaacagctagcaaactgcaggtcattgtccttaactcttcccttcatcaagatatgagaatcagtaatatccaacttgcattccttgtaatcagatttttcctcctcatactttccatcagaagccaaatcacgacttagcgacagttctatagtaaaatctagagtttccgccccttccttagtaaagcgctgaaccaagagattatctggaaaactcgcaaaagcttcacgttcaaatttcgttcccttatagacataagaagtcgtcgcaagcgccttactgatattcagttgcctctggtaatccgtaacctgagacaaagtcgtaccttgctgactaaactcaatgtgaatatccccaaaggatagataggtcccatattgactcgtttttggcccgatcaggtgctgttcagccagttccttagcccgattgtaatctctcttttccaaagcctgccgaatctcagctaaaaaaccatactggtcctgaagatttccaccctgataatcggaactatcaggaagtggaccaccagaccagagacttttttcattaaattgaatcctctcagcccctataatcccaaatacttttgcccctaaagaaccattgcctattggtaaagcctcttcttcccaacccttatatgttgttgaagctggtctcttgtaggccaatacataatcttgttttttattccttatcatactaccatactaacataaaaagcctagaaatcaattctagacttacaattttttattttccaaggtagtattcagaaactacgttcaatttttcgtcgaattcgaataccaatggtgggaagttagggatttccacgtccatgatttcgtcgtctgacaaacctttgatgtgttttacaagggcacggattgagttaccgtgagctcctacgaatacgtttttaccatctttaagagctggagcgattttatcttcccagaatggaagggcacgttccaaagtcactttcaagttttcagcatctggaataactgaatcgtcaagtgaagcgtaacgacggtctgtgtgagctgagtgctcatcatcacgatccatgtttggaggcaatacatcgtatgaacgacgccagatgtgaacttgctcatcaccaaattgttcagcagcttcagctttgtttttaccagtcaaaccaccgtagtgacgttcgttcaaacgccatgatttttcaactggaacccacaattggtcagaagcttcaagagccaagttagttgttttaatcgcacgtttcaatactgaagtataagcttggtcaaattcgataccagcttctttgatcaatttaccagcgtcaatcgcttgttgtgtacctttttcagacaaatcaacatcagcccaaccagtgaaaaggttagctttgttccattcagactcaccgtggcgagcaaaaaccaattttaccattagatggattctcctttaaattttccgaggtttcccctcgtttatctattctattttacacaatttttcacaaaaaagctagtcaaaaccaaaaaggaaccgactgtttggcagtgggattgctttaaacaaatataagcaaatatgtgaaaagaaatttccatttcactcttgctaatctccttgctttttgttagaatgatgtcaaaaaataaaaaaggttaacattatgccacaacatctctttaaagaattggctcaactggagcaagtagaggctctagctctaggaagatcacgggctggacaagattttgacaaagactctgactatgatgtatatgtctacctcagtgctcccctctcgccagacatcagagaagaaatcctcagtaaatactgctcctatatggaaatcggcaatcaattttgggaattggaggatgattgtgttctcaataatggcatagagattgagctgatttaccgctctctagacgaatttgacaaagatttacaagccgtagttttagagcaccaagcccagaattcttacactacttgtatgtggtacaatctactcaacagcaagattctctacgatcgagatggtcactatgctgccctccagaaaaagtacaatcttccttatccagctgagctgaaaaagaatatcatcaacaagcaattcctgcttctcgaccaagctatgccagctttttcaagacaaatcaaaaaagctctcaaacgccaagacttactcagcatcaatcaccgcagtagcgagtttttcgcttcttatttcgatttgctctttgccttcaatgagcaactccatccaggagaaaaacgcatgctccagtacgcaaaaaacaattgctctcatctacctcaaaattttgaaaacgatattcaagactactttcaaaatctctaccaactagatcaccagcagaaaacagtcctaactttggagcatctcctatcaaatcttaaacatttgattgatgaatccatttagaacaccaacagataaaagctcatgaaatctacttttcagatgattcatgagctttttaaatttccataatatataacgatttaaagttatactaaatgaaaatcaaaaagcaaactaggaagctagtcgcaagctgtgctgaagtacagtgaggcgacattgacgtagtttgaagagattttcgaaaagtattaattgaaacaagaaaacgacaataaacttctaacatgataaaaacgcatcgtatcaggtgttcaaaaccttgatacaatgcgctttatagtctataagattagttgtcttttcttctcaaattgagttttgcctagacttttcaaccttatttctcttcaaatccttctgctactgcttccgcaaagttttcttctacgatgcttgcacagtggtcacagatgactgcgtggtagctacgttctgctgttgttgggtcgatacgacggcaacggtcacacacatcacctgcagcgcgttctactgtgaaggctacatcttcgaagctaacagcagcttctggagctggtccttctgcgatagtcaagtctgacacgattaaaagttgagccacattgctgtttactgcttcgagtagagttttcaccacttcatttgggtaaactgtcaagtgtgcttcaagtgatttaccgataactttggcattacgagcctcttccaaggctttttgagcttgtccacggaagtccatgaaggctgcccatgtatccaagatttcttcttgattagcaaaagtttgtgcttctggcaattctgacaattgaacgaagtcttctgcttcaaactcaaggtatgaccagatttcctctgctgtatgaggaaggattggtgtcaagagtttggtgattttcacaagaatgtcatagaagacagtctgcatttgacggcgttccagtgatttggcaccttcgatgtaaacaacatctttagcaaaatcaaggtagaatgctgacaagtcaacgttgataaagttcactagtgctttatagattgtcaagaattcaaagtttgcataagcatcacgaatggtcttgacaagctggttaaagcgaatcgtcatgtacttatcaactgaacgaagttcatcgtaagcgactgcatcttgagctgggttaaagtcagatgtattggcaatcaagaaacgaagggtgttacgaatcttacggtaagtttcagagacttggctcaagatatccatagagatacgcacgtcgttggttgagtctacacttgttacccaaagacgcaagatttcagcaccaaattgtttttcaacatcgcttggagcaatggtatttccaagagatttagacatcttctcacctttaccgtcaagtgcaaaaccttgtgacaagatttgtttgtaaggtgctacgccatggttagcaactgaggtgatgagcgatgagttgaaccaaccacggtattggtcagaaccttctaggtaaaggtctgctgggtaagtcaactctggacggtttactacaactccattccatgatgaacctgagtcaaaccaaacgtccatgatatcagtttcttttttgaactcgccgtttggtgaacctggatgagtaaatccttctggcaagaggtccttagcatcacgttcccaccaaatgcttgaaccatgttcctcaaagagttgagccacgtgttcaatcgtttcagcagtcatgatcgctgtaccgtcttcagcgtagaagataggaagtggaacaccccaagcacgttgacgagagataacccagtcgccacggtcacgaatcatattgtaaagacggactttaccccattctgagtggaatttcactttttcaatttcatccaagatttcttggcggaatttagaaactgaggcaaaccattgtggtactgcacgccagatgattggtttcttagtacgccagtcaaatgggtatgagtgagagatttcttcttgggcaagaaggaggttaccaagtttctcgataacagttggaactaccttttcatagaattgaccttcaaactcaggaccagcattcttcatcatgataccacgttcgtcaacagtcactgcgacttcaagaccattagcaataccgacattgtagtcatcctcaccaaaaccaggggctgtgtggacgatacctgtaccagaatcagttgtaacgtggtcaccaagaataaccaattcatctacagctgtatcccatgggtgttctgttacgatatggttgagttcttgaccacggtaagttgccaaaacttgaacatcagcccaaccaaatttctcagacaagctagtcaataattctgcagcaaccacaaacttacgagcttcaccagcaggttgaaccaaaacgtaatcaatatctgcaccaacagtcaaaccacgagaagctgtgatggtaaatggagttgttgtccaaactacgatataagtatctgtatctagaacacctttgccatcttttaccttgttggcatagtaaagggaagttgaaaccaaatcatggtattcaatctctgcttcagcaagagccgactcagatgaccaagaccagtaaactggcttagcaccacggtagatataacctttattagccatctcaccaaatacacggatttgagctgcttcatagtcaggagtcaaagtcacatatggattttcccagtcaccagaaacacccaaacgtttaaagtcttcacgttgtttatctacttgagaaagagcatattcacggcaaagtttcaagtactcaaccaagtccatttctttgcgtttgataccttgttttgccaaaacttgctcgattggcagaccatgtgtatcccaacctggaatataaggagcataaaatcctgacatagacttagaacgaacaatgatatcttttgaaatcttgttcatagcgtgtccaacgtgaatatttccgttcgcgtatggaggaccatcatgcaaggtgaaatgaggttttccttggttcaattcttgacgacgttgataaagttttgcatcttcccattcctgttgccaaactggctctttggtaggaaggcctgcacgcattgggaaagctgttttcccaaggttaagggtatctttgagtttcatggtatctcctttataaataataacaaattaaaaaccacgacttccaaaaaggacgaaaatcgtggtaccacctttattcgaaaaaagactcagcttttttcctcttatcccgtaacgtggggaacgtcaaatcttacttcattcagacttgattgtttgagaggataatcttatcattagggaatgcaggactcacaccatctcctgctcgctggaaatataaggataagatattgttctcagattatttcttataaaattgtaacagattcttgcggtgctgcaaaacctggttctgagtttacagcttcagtagctggtgttggtcctgagtaatggcttggagctacttctggctcttcatacattggaccaactggatgagctggactttcttcaacaaccggagctggtgaaaccaattgttcttgctcagctctagcttcggcttccgcaagttccttattagctgcttcgatacgcgcttgcaactctgccatttcctcgggagaaaactgacgagtaatatcaattggttcttcctcttgatgttgttgtaagacagaatcacctaagacttcacttaccacttctttgaaggcttcatcacttgtttgaagataagtcgctgttggacgaagaatgtcttcccaatctgaagattcaacaattgctaactggctctcaattgtagatttgagacgttgatggaaaacacggctcttgttcttcaattcttctgtttcaacagcaactttcttagcattatcagttgcttgacgaagaatttcatttgccttgtacttagcttcttccaacaaacgttgggcatcttgctctgcttgttggataatattatttgaacgttccgttgcagcttgttttactcgctctgctgtatcttgtgcaatcaatacagactggctcaatgaatctttcatctcatcaaagtaagacaaacgctcttccaaactcttaatatgtaaatccttatcatgattagagcgaaccaaatcttcataatcacggactacaatatctaaaaactcatctacttcttcttgatcgaaccctctgaagcgtgtgctaaaagttttatctttgatttctaacgatgtaattggcatatttttcctcacttacttaataacaattggaccgttaatttctttttatctttttttgtttgcccattatctctaacgagtttcactcgaccaaatttccttatactaatcaaatcaccaacttgaactgcataatctgatttttcaactaaatggtaattcacttggactgcctgtttttcaattaactgacttgcttgatttctagacagcttgaagacacctgctagaaaaacatctaatctagaactagcaatacatatatctaattcttgataatcttctacagtagcaattctctcagtaaaatgctgttcttctagatgaaccggtaaacgagcaattttcgtaatgccgtcttgaaaaaggagcataaactgtcgattaatgataatctgtgctctctcttcgttgactaagatatcaccaaatagcttcctatcgattcctagctgatttaaaacagttcctaatatttttgcatgcgttaggcgttcaaacttattaggatagactatttcttgcaaggaaagttcaaaatcagagaattccggctcaaaataatcaggatacaggagaacccgtacatattcagtttcaagaaactgccgactgctcatgtaggagatgccgttggttgatgctagcacctttaaaatcttttcttgatggggatttacaaagggtgttaaaaaaggagaataagaatcttctaccttttttatccattctaatcccttatcaataaaagacgaatcattcttagaaaagtgttgataaatcatcttgttcatagaaagatcactaaaagtcgaatcaactgctcccctaggaagtgaactagtaataccgcaatccagacagataagtcaagacctgcaatctggaggggtaaacgttgcaagggagctactatcggtttcactaaactaataatcaagcgtccaagacgtgattcataagcattgggaaaccaagacatcagagcaaacacgattaaaatcagtgaatagatatccactgcattttgaacaaaacgaatgagaaagatcattatctcactctcgtacgtttcatatcaaagccaaattcaccattttgtgattcatctggaattttgatgtcttcaatattgacgacaacatcaactggtgtcagcaggtacatagtagatgctacctttttcatgttaccagctaaaacatggcgtgccccgtccagataatccaaacaacgacgtgcttgaacttctgtcatatattggaaatcaatcaaaatactttcgttaccagctaataaatcaacaatatctgtggcatcttcgtatttacgtggataacgaacatcaattgtcaccttatcagtagaacgttgactttgcatagccaactcttgttgacgggcatgaagacgagtgatgtttttatctttagatggcgtgctaccagcttgttgaggcaactcttgaacagaagggactggagtcacaattggctcttcagctttaggctgatatgcagtaccaacatcttctccatcttctgtaaaataatctataaatttatcaaatctatcttttaaagacatatttctttcctatttaaaaaatgctgtaccaattctgacaaatgttgagccaaattcaatcgcttccttatagtcacgactcatacccatactcaagtccgtcattggcatattgggaatttgtttttctctaatttctagttgcaaatcctgcgtagctttaaaaatttctttcaactcatcactactagcttcaaaaggagccatggtcatcaagccgacatattcaattttatctaaggtggccaattctggtaagagctccaatagttcttcccttgaaaaaccatgtttgctctcttccctcgagatatttacttgtaagaaacacttaacaactcggtcacttcttttttgaatttcctctgctagctttaatgaatccaaagcgtggaaataatcaacatactgaatgacatctttgaccttgcgtctttgcaaggttccaatcaaatgccaggtaatatttctatcttttaaagcttcatatttctcaagaaatttatctacacgattttcaccaatatgatgcacacctagcggaagcaaagcctccgctgtcggtacgtctacatattttgtaacagcaacaaccgaaacagaattagcttctcttcctgcctgctgacttgcatcttttatttgttgaaaaacacgttctgtattttctttcaaattcatttacttaacgatttttgaaaaatggaggagtgtctaattcatcctcatcgtgtaaagatggtgcttcgaaacgttcaactggtgatacaactgaatcagttggtcgaacaattgtctcacgacgcaagtcccaatcaccaaatgctgaagattgagaagtttctgtacggcgaggtgctggacttggaatttctgcagtttcagccatatcaaactgacgattatgattgtgtgcatgactaggacttgcttgttcatgacggacaacttgtcttggtgcatggcccacaactttttccacacgatcttgacgaacaccagttgccacaactgtaacacgaatttcatctttcatgttttcatcgatagatgttccgagccagatgttcactccttgaccagctgcttggttgacaatttctgatgcttcttcagcctcaatcaaggttaaatcaagaccaccagtaacgttgacgataacatcctcagcaccgtcaatagttgtttcaagaagtggtgagtagattgccttacgagctgcttctaccacacgttcttcaccactaccgataccgatacccattagggcgtttcctttatttgccataactgttttcacatcggcaaagtcaagattaatcaaaccagggtttgtgatcaaatcagtaattccttgaacaccttggcgaagtacgttatctgcttcgctaagagcttcaagaagtggagttttcttatcaacaatttcaagcaagttgttgtttgaaataatcaatagagtatccacatgctcacgaagttgattgattccttctacagcatactgaccacgtttgcttccttcaaaaccgaaaggacgtgtcacaacaccaactgtaagagcacccaaatctttagcaatgcgggcaataacaggagctgcaccagtaccagagccccctcccatacctgcagtaatgaagaccatatctgctccagtaatagcttgagtcaaggcttcttcgctttcttcagctgccttttgaccaacttcaggtcgaccgccagcacccaaaccacgagtcaatttagggcctaactgaattacagtctcagcttttgtactactcaaagcttgtacatctgtgtttgctgcgataaattctacgcctgcaacaccttcgtcaaccatgcggttaatggcgttaccgccacctccaccaacaccgattactttaataactgcaccttgagctgctgctgtatcaaatgaaaatgtcatagtttatttttcctcttttattcatcaaacatgcttccgattaagccacggaaacgatctgcgatttttggtttattttgagaagatactttatcttctttcggagcaactacgttcgtagaagctgattgctctacctcagtattttgaactggttgaataggggtcggttgtgctacctgcgtaacgcgttgaatcatcccaccgaaattaattggttggtgacgcaaagtatcctcacccttgactgctctttgtgctaataaatgcacctcagtcaattgaccagcaaattcagacaagctaatcacatgagcgaaggcaggattacggattccaacttgatttggaacgtaaagtttgacaccaacgccaaagacttcctgtgcaagttctacaatacctggtaaaatagcatttccaccaatcagaacaatcccacctggaagatccaacaaatgtcttctttccaactcttgtttgatttgttcaaaaatgtgcttaatgcgggctgaaataatctctgctagatagctttctgtaacttctacaggttctacttcaccaattacttcaacttggaaggtttcattgcttgcaagtgaagggtaggcttcaccatagtttaatttcaatccttcagctaatttctgtgaagtcttcaagactttagagatatcttttgtgacataatctccaccttcttgaagaatatttgtaaactggagttcttggttacggattgtagcaacagttgtttgacctgctcccatatcaatcacagtagctccaaattcacgctcaccttcattcaagactgaacgaaccaaagccaatggtgaaataataatattttcaacttgaacacctgagcgctcaactgtcttgcgtaaattgtgaagaatagtacgtggacctgtgtaaagcaaaccacgcatttcaagacgaacacccatcatgccgcgtgggtcacgaataccttggaaaccatctacgataaattcttctggaataaaagtaatgacttcacgatctggtgtcatactctttgtcaaggctgatttaacaacattttcaacatcttgatctgtaatttcttttgtatcagatgtaactggaatcataccttgagttggttctacttgcaaaagatttccaggcaaaccaacattcactgatttgattgaaatgccagctttctcttctgcttgggaaatagctgacttgatagcagttgctgctgcttcaatatcaacgataatcccatcctttacacctttactcttggcattacttacaccaattacgtttagttcaccatttctatgctcggcaaccaatactttaatcgaattagttccgatatctaagcctgtaaaaaaaccatctctagccattacatcgcatcctctctcttccaagtttcaaacttctattcaatatagctaaaatagggcatagctattcacagaatattataacacaaaaaatccaatcgtgcttagtttttcctaaatttacttaccattttttcacattctttccttagctttttttattttccaaacaagttataaaaaatcagatttatgaaaaaaagaaagctcatttctaagctttctttgcaatcattttttctgcttcttgctctaaaaatagttccaagattttctttgttaacgtaatcgctgctgataaggccagggaaacgattaaataattagctactaagccatggtctccaaccaatggtggttttgtcaagaatccgtaatctccacctgttactaaattgaccacaaaaatcaaggcatttagtgcaaaggtcatgagaaaaattcccttcacatccagcaatcgcgcgttatactgtctcaatagataaactaaagagttccccaagagagctaagtggccaaagataaaggataaaatcgtaatatgtgggaaaggataggcatctgacactggataaacaaaggctgctaatgtcccaaatgttcctagtaatgcaaaatactgcctatatttggactgaccaggtagcaagagcaccacaaacatagccatacgacaatggtaaaagggtaaactttctgacagaggcatatgattgaccccataccaaccataaagcaggatcaactgaaccgcctgcaagatttggaaaaatcgttggtaagccttcttttcacgataacgataggctgtataaaaggtcaaagccaagagtgtaaatatactgacataccaaaaaaggtcaaatttgggtggctctgttgcttgggtcgtaaagaaaatatcccataaattcatctagtcttcctcatgattcaaaattttcctgcatattattataccatgctatttgtcaaaaatggatttagaaatacgtaaatgtttgacaaaatcactttgcttcattttctaaactttctaacaacttggctagattcatagagttagagcctttgagtaggatttggtcattgactccaaggctttctttgacctgcttaactaggtcttcaaattggtcttggtcttctgttttcttgaagtagtaaacgtggccgattgggaacatttgactggccagttgagccaattcagcaatgtcttctccgtagaaaatcacggtatcaagcacatctggtgagaggctcaaaatcatctggttatggagctgaacagactggtcaccgagttccttcatgtccgctaagacagcgatttttttgccaccttcgttggctggaatagccgaaaaagtctctaaaatcaacttcatagcagttggattggcattatacacatctgatagaatatctgcaccattggctgctttcttccactcagtacggttacgcgtcaattcaagattttggaaggcctgacgaatttgctcctctgaaactccttcttgtagggcaacataggatgcaatcatggcattagtagcattgtacttaccagtcactggcaaatcaagggcttgttccaagaaattagccttaaatgtcagactatccttgcgctcaatcaagtctgtaatttccaactctgctccttggccaaaacgaactacctttttgtcagttggcaagtagtcctctacaatcggatctgctggtgccaagagcaaggaattcgaagacatcccgtctgcaatttgcatttttcctttagcaatctccgaacggtctttgaaaaaggccaaatgggcttcgccaaccaaggtcacgatggctgtttttggatgagccaattcagacaagagatggatatctcccaagtgatcctgccccatctccaagaccaacttttctgttccttcaggcatatggagaactgtgtatggaagaccaatctcattattgtagttaccttgtgttttgtaggtcttgtaggttgttgatagcaagtgcgctaacatatccttggtcgttgttttaccatttgaacccgtaaccgcaaagacatcaacagctgttttttcaagatagtaggctgctagttgctgaaaggcagtcagaacatcatctactagaatgtagggatgatttgcgacctttttctcagacagggttactgctgcaccattttcaaaggctatttcgataaagtcatggccatcacgcgcacctttgaggggcacaaataaatctcctgtcgcaatcaaacgactgtcaaactcagccttttctaactgagcatctgcaaaaagactgacattatttttagctccgacaacttgagccacttcatggattgttaatttcatttctactcctttaaaaagggtcgaagctcgagaactctagtcacctttcagtgatggttctggcttctaccctctctttcattttatagcaaatgcgcttcgcgcttgtcaaaactttccttggcaaggtcaaccaaacgctcgattagttctgggtagctgattcccatattgtcccaaagtagtgggtacatagaccactgggtgaaacctggcatggtattgagctcgtttaggaaaatctctcccttatctgtatagaagaaatcacaacgagatagacctaaaccaccaatagcacggaaggcagtttctgcattctgacgcatgacagctaccacatcatcactgattttagctgggatatccatggtaatcttgttatcaatatacttggcatcatagtcataaaaggcaacatccttaactacttctcctggaagcgtgcttttaacatcgtagttacccagtaggccaacctcgatttcacgggcatttaccccttgttcaaccaagacacggctatcatattggaaggcaagtttcaaggcttgacgaagttcctcttgattttcagacttagaaataccgacactagaacccatgttagatggttttgtgaaaactggataagtcaatttttcttcaacttcagcaattttagcagtcatatcatcaccttcgacaatggccacataaggaacttgggcaatcccgacagattctaacacacgcttggtcgtgattttgtccatggcaaggctagatgacaaaatgttgcaaccaacataaggcattttcaaaacttcaaggaaaccttgaacagagccatcttctcccatcggaccatgaaggactggaaagaccactgctccctcttcatatatggcacttggtgcaactttcttatcccaatcaatggtttcattggtcataagacgatcctcttgacctggagtctggttaaattcttgcgttttaataaagtcacctgactggctgatgaagaaagtcttgactgtgaaacgatcgtagttgaccgcacgcataacactttccgctgaaaggacagagacttcacgctctgcactacgcccaccgtataaaagaataatcgtttgtttcatattatttgttccaattctaatagaatacttgttctttagtatatcatatttgcttcttttttgaaacttgaacctgatactggtcttcaataaatctaaaaagagaccgataaaacaactgtcggtctccgtgatttttgtataaatgaattgagtgtgttaatttgtctagacttacaactctgttcgattttcaatggctcgtaagagtgtcacttcgtccgcatactcaatgtccgctccgacagcgagacctcgtgctagacgcgtaaccttgataccagctggcttgagcaaacgagaaagatacatggaggtcgcttcaccatctgctgtagcattggtcgccacaatcacttctgaaacttcactatccataagacgagtcataaggctcttgagattgatatcgtccggactgataccattcatgggagaaatgagtccatgcaagacatgatagagtccatggtattcttggatattctccatggctgccacatcgcgactatcttcgagaactaaaatcgttgtctggtcacgagtcggatcggtacagatagaacaaggatcgtcgtctgtcaaacgtccacaaatagaacagtaggtcaattctctcttagcagaaaggagatttttagcaaattcattgacatcatcatcagacatcccaatcgtataaaaggccagacgggtagccgtcttaatcccgatacccggtaacttagaataactatcaattagcttggcaataggtgttggataaagcatatgttcctttctaattcattggatgatgttggttatagaggttgataatatcgcgcgcaatggaaggtccgacaccatttgtaaggttggtgttatgagggaagacaacagctacagcgatttgaggattatctgatggtgcataggccacagcattagtattgttagctttttgaccaccctcaacataactttcggcagtacctgtttttccactaatggataccgctgcgccatttgaaaaggcacgaccggttgtcaaagcacttccaccatgtgaaacttgataaaatccttgttgaagaatggaaacatcagactcagaaatattaattttattcatttccttggtttcaacagattggattaagttccctaaaccaccttgttcgttgtttccataaatcccctcgacaatgtgaggtgcaatccgaacaccgttgttggcaatggtgccaacgtactgggctaattgcataggggtgtagttatcaaactggccaaaggcattggtaatgtaattagcaaaattatactcttttggtataaaaccagttgactcatctggaaggtcaatgcctgttgaggctccaagaccatattccgcaaatgtcgagcgaagtttccccatggcggattctaaattgttagttagaacaaacatattgggttgataggtctgacccataatgcccaaagccgtttgaaccatataggtattagaagaatactccaaggcttccacagctgtaatcgggaatgaaccgtaagcctgagtgtaccaagaattaatcggagctgaaccttggaagacaatcggttggtctgtcaaggtctgattccctgataagactccattctcccaaccagagctgatggtcgccgccttgacaacagaacccggcacaaagacattggttactgttcccaaggaatcaggtgttaaatctcccgttttcaagtcatgttttagccctgacatagacaaaaccgcacctgtttttgggttaagggcgactgcatacacaccttctgaatacttggctcctccatttcccagttcggaattgaaataactcttaagcagattgtccacgctatcttggaaggccaaatcaatagtcagtttaatattattccctttggtaccatcttcgatattttcgacactttccatgttaccgtacttatctagatggatttccttaactgagcgttttccttgcaaggtttcttcatattgtttttctagataagaagtcccaacacgatcatttaaagaataaccctttttgatataagcatctgcttcttcagctggtagaccagctttttcactggatacacttcctactatagacgaaagagaagtctctaggacctttcgatcccacgaagttgaaatactgataccaggtaaattcttagaagccgaagcaatcaaggcaatctgtgtgtttgacaaggaatctgtcgcaatggtgcctgtcgcaaaatttccaactgcattgagttggctaaagagataaatttctttcttttcgtcatccgagtaagccaattgacttggatcgatactttcaacagtattattgtaaagctcagattcagataattgattgccatcagaatcaagtcgcttctcacgtggtaaactttccactgctttcttatatacatcttgatctgctagataatagtccgccaactgtcgatcagtcaatgttggagaagtaactcccacataagccagcaacttcttggctgtttcttttaaatctgcagccgtcattttgttgtttcgagtaaaggaaacgacttgtttcacagtattttcaaccaaaggcttgccactagcatcataaatttcgccccgagccgaactagtagtcacctttgttttactagcagatgctaattttgtctcataaaaatccttgttcaaaacctgcatataaagcaggcgaccaataatagccataaagagtaaaatgacaatcgaaaacaataaattaagccgaatcggaatcgaatggctgtcaaattttctcatacaaatcagtctcatttctatttaaaatcttactcttcattgtaccacaatttgagcagaaaattatggaaaagcaagaagctttttttcgtttttacagtaagatacgtttttatttattcatccctatattatatgttataatgaatgtaaaagttcaataatctagtctttttccaacacgactcatttaaaggagcctttctatggacaaaccagatatagcaaccatcattgattcccacttcgaagaaatgacagacctagagcaaggaatcgctcgctattttttgcaagctgaaacgattacagatgatttatcttcccaacaggtcactcaaaaattacatatctctcaggctgctctgacccgcttttctaaaaagtgtggttttacaggctatcgagaatttattttccaataccaacaccaagcagagaaacaggacacccattctcacaaacacagtccactgacaaaacgagtccttagaagttatagcagtatgcgggaacaaacacaggacttgattgatgaagtccaactagaaagaattgcccagttaatcgaagatgctgagcgtgtctacttcttcggaacagggagttctggcctcgtagctcgtgaaatgaaattacgcttcatgcgtctaggtgtggtctgcgaggctttaaccgatcaagacggttttgcttggacaaccagtattatggatgagaattgtctcgtactcggtttctctctttctggcacaaccccttctattttagatagtctattagacgctaaggagatgggggcaaagactgtactttttacaagtgttcccaataaagatagtcaggcctatacagagactgttcttgtagccacccacagccagtcatcctacatccaacgaatatccgctcaacttcctatgctcttctttatcgatttgatttatgcctactttttggaaatcaatcgagaaagtaaggaaaaaatctttaatagttactgggaaaataaaaaactaaacggctatcgtcgacaaaaacgtgtaagaaaatcctagtttggctcagccaaactaggatttttattcatcactaaacatacctcttctagattatgaattagtcatatcttgacttggtcttgaataatttcatgtaatcactttttgaagggagtaaataagcaagtctgacggtatcctcaacaattgtatataatacgatgtaatccttactcaaggtcaatcctcgcgtttggtagcgagggtctaatttcttaccaaatttttcatcggcatcaaatccagcttgggggaaaatttctagacgattaatatcttttctaatactggctacttttcgtctcgcagcctctacagaaccaatttcctccgctatatactgatatattttgtccagactatcaatcactctaggagaatacaaaatccgatattttttataatccatagcgtgtcacgacatcctcatctgtcaagtaatttccagcctcaatcttggcataactttcttgaacttctgcttgtaattgtctaaacaaatactccttctctaattcctcttcactcagtaaatctacttcatttgttacggcaacattctttaaaaataatctgagtgctgatgaaagagagagattttgttcttttaacacttccatggcatcatttaccaattctctattagcttggaaggtcacaattttatttgaattcgctatagccattttatataattcctttatatattttatttattatctcacaattataaagaaagtcaagggaatttgatcagaaaatcctagtttggttaaaccaaactaggattgttttgttttaaagtgataataagctcctaacatacctgctgtattttgatgatgggcaaattctaatcgtgttttttcagcaaggcttggtaccaaagcatctttcaaagcttttcgaattttaggcttgaggatagcctcttgccccattataccgccaccgagaatgactacttctggattggccacatagcaaatatttgccagaccttttcctagatagtctaccatccggtcaataccagccatgcagattttgtttccttcagtggcttccttaaagatacgtcgaccattccactggtcaactggatctccatgacctgctgctacatactccaccaaggctgtcgtagaagcaagatcttggaaagcaccatcctgcatgtgcatataaccaacttcacaggctgaattgctaaatccatggaagactttcccatccataatcaagcaacccccgatacctgttccaatagtcaagcaaagagtgacactcgctcccttgcctgaaccagataccgcctcagccagacctgcacagttgacatcattttcaatctcacaaggaatcgcaaagctagtctcaatttccttcttaaactgagttcctgcataattagggatttgagggcctgcatagaaaatctcacccttgtctggatctaccatcccagcagaagaaatggcaacacctgctactgggcctttttctaaatagctggctacaatatctttggtcttttgtaagatatgaggtccaccctgatgcgcctctgttggcatttcatgcgattcaacaagttggccttcttggtcaatcaaaccatatttgatgttggttccaccgatatcaattgcaacgtagtgtgtcataaatacctccttatgaattagaggaagcgctccttggtttcacgaatcaaggctgcagctgcttctacaactggacgatcgtcttcagtcactggtgtcaatggtgaacgaacagaaccaatattcaagccttcattgatcttcaagacttccttaatcacaccgtacatatttccatgtgcagcagtgagtttaccaatgatagcgttgatagcatactgcaattcacgcgctgtttccaagtctttgtcagcaatcaactgattgagtttcaagaaaagttctggcatcgcaccataagtaccaccgataccagctttagcacccatgaggcgaccacctaggaactgttcatcaggaccattaaagacgatatgatcttccccaccaaggctgacaaaggtttggatatcttgaactggcatagaagagttcttcacaccgataacacgaggatttttcaacatttctgtgtagagacttggagtcaaagcaacacctgccaattgaggaatgttgtaaatcacgtagtctgtatttggagctgcagaactgatatcgttccagtatttagcaactgagtattctggtaagcggaagtaaatcggtggaatcgttgcaatggcatctacacccaagctttctgcatgacgagctagttccatactatctttagtattattgcaagcaacatgggcaataatagttaatttacctttggcaactgccatgacttcttccaagattaacttgcggtcttcaacgctttggtagatacattcaccagaagaaccattgacataaagaccttgaacacctttatcaatgaagtattgaaccaaggcacgcgtacgctctggacttacttctccttgatcatcataacatgcgtaaaaggctggaatgacaccttcatatttttttaaatctgacatagattttctcctaagttttctttttttctgctaaaagcaggatttattctttacgtgtttagtatacaccttgtgaaaaacgctttcaatatcttgtgtacacttagattttagtttcgatatgtattttgaaatgtttatggcttgaaagtagtttcagaaacaagccatcctattggtattttgcgaaaattttctccatcaatccagtctggataaagaccaagagtccaaacccaaaaagtaggaaggctgagccacctaaaagtaaactgaaggcggacagataaagaaccatcacaatgagaaagagaataactaacatgagaaagaaccaaggaaagttgaaacttgccaagataagtcctttttgtagcacttctttccaagtcaaatcatagcgcgcagctatagggtagctagccaacatcacgatagtgaggaagataagaacacctagacaaatagcttttaccatttggaaaggcatagctgtctgcccccaaaaaagatagaggtctaaaatacttaatgagacgatacccaactcaagcagacctaactgaagacctagtttcagattttgcttgaaagctcttagatagattttaaagacaggcacacgtctactcttcttaatctcaaacatagtctcgtaaaggctaattttagccactccaatcgtcacgatgggcaaacaagagacaacaaaaagaagattggctgtcacgatatccaagaccttctcactaaaacgcatgagaaagttatctgtatcaaatgctgccttgataaggcttactcctttttgtgccatgtctactcctcctgagtttttaatcaatcaaaattttaaagagatatttgcgaaccttctcttccatacctgcatagccatttggctggtgtggttctcctgggaagaaaatcgcaaaattgtgataacccaacaagagtgggtagtgttcatgacaatgcacaaagccaatgtcacttgcttcgtcgaatgctactgcctcgtctttgatacgtgaaccgtaactcgaatattcatgtccttctaccagtaaatgcaaatctgcatagttctgatgatgctcaaattgatcattttcagcttgattgaggacattttcctgaacaactagaaagaccttgtccccatcaatctcatactttcctaattcgaaagaatccttacggtgctgatagagatagtcgatagccttgtctagattgggatgaattcctttgtaaaaggtgatgtttttcaaatcgtcaaaaatcatactctttccttcgtttctgatagttaactaaaatcataaattaagtttataagtgtctaacagaatctctaaggtaagcaaatacccaacattttgtagacacttataacatctatatttccatagcatgtcaagaccacttccgcaatcttgacacaccagtttacttttcttaacctttgaccgctcccatggtaataccttgagtaaaggatttttggaagactaggaagactgttacgattggcacagcagcaagagctgcacctgccatgatcaaaccatagttggttgccatttcagcctgcatagtcgcaacaccgagtgaaatggtcaaattattacgtgaagtcaacataaccaactgcatgaagtagtcgttccatgtattgatgaaggtaaagattgcaagtgctgcaaatcctggtttcacaattgggaaggctacgctccagaaggtacgaatctcaccacaaccgtcgattttagctgattcaagcaactctgtaggaatattctcactgaactgtttcatgaggaagaccccgaatggccatccaatcaaaggcaagataactgcccagagagtatcgtgaattcccatgaagttgacgatacgtaccaatggtacaaggacaacttgttttggaagtgccatagcagcaataaagattgcaaagagaatacgttgcccatagaaacgttttttagccaatacataacctgctagagatgaggtcgcacagactaagaacatggttaccaatgagataaacacagagttccacatccactgcatagcagggttttgcaccatgagttgttggaagttttccatggttggcattttagggaaccattgtggtggaataacgatggtatcaggttgtgatttgaaggcccctgtcaaaatccagtagaatggaaagatgaacagcacggtcaacaagagcaagataatagttgaaataacagtgaaagctgttataggtttcttttgtgtagattgcatagctgtctcctttctttaatattctacgtcatttccgagcgccttaaattgaacaaagcttacaatagcaatcatgactgccaagaagacaccaatggtattagcatacccgtattcggtcaattggaaggctttttcgtaaaggtagtacatcaaggtacttgttgagtagtttggcccaccagatgttaatagttgaatcaaggcgaaaacttgaaatgagttaattgttgtgatgattgcgatgtagagagttgttggaagaaggcttggccatttaatcttccagaaaacttgaaattcagttgcaccgtctacacgagccgcttcaaccagtgaattgtcaatattccccatagcagctatgtagaggatgattggttgaccaactgaagttgtcaagaggataatcataattgccagtaatgcccagtgtttatctcccaaccaagaaatattctggctgatgatatggcttgacttaaggacaaagtttagaatccctgataatgggtcataaatccatttccaaacaactgttacggcaacactacctgttacaacaggaaggaagaagacgaaacggtagaaagatctggcaatagcattttgatggtaggtttgcgacgccacaaagagcgaaaagagaacaacaatcggtacagatccaacaaccaaaataactgtgttaatcaaagacttcataaagacagggtctttaaacatacgaatgtagttgtccaatcccacaaactcaaatttagtcattgaatagttaaagaaacttgtaatgaatcccataatcataggaaccaatacaaagatgacaaagaagaataatactggtgctaagaaagcgtaggaaatcactgtttcccgcatacgaattttattgactttcacagtcggcacctctctttcacaaatagaatattttggattttcttgaacagttttaaaatcaaaatgaaattttttaagattcgcttatgtaagaacttcattttaatttcgtgacagtttctgatatttcaaataaaatcctcccttttcttacatagattatgcacagggaaaagggaggagtcaatctgattcagtgcttattgttttgtagcttttttaattgtttcgttagctttttcagtgaaggcttttaaagcatccgctggtttttgatcgccatttgaaactgattgcaacattgggaaccatagagttctcatttctgcaaaaccatcaattgtattgtagtatggtgagtagtatttagtccaaccactgattgtttccatacgtttatcttcataaagttttccaaatgaagtacgaactgggaaggcacctgtacgaacaacgtcttttggaccccattctttgtcatccgcgatgaattgaacgaatttcttagatgctgcaactttcttgtcgtctttgttgttgaatactgcaaatccgtttacaaggtattcaagagctggtttacctgaatctgatgggaatggtacttctaccacttctactttacttgcttccaagagtttagcttggataccgttttgagctggcgcccaaaggattgtgtaagatgtttgaccgttggcaaagttttggatatctgctccaccgtcaaattgtgaaccgttgttcaacaaaccgtctttgatccagctagctgctttttcaagacctttgacgaatttaggatcatcagttgtatattttgttacatctttatctgttacagaaccgccgtaaaggtttgagatgaaggcacgtgttccttggtctcccccttgaccagaactgaacaatgaacctggtgtgtagcctttgtctttaagcgctttcaaaactttctcaaagtcgtctgttgtccaaccttcttttacaaggttcgcaactccagcatcttccaacattttcttgttcatagccatgtagaatggtgctgaactgattggatacatgtaggctttgtctccagccttacttgcttttacaatgttttcattgttgacatctttaacaaagtcatctgtgaagaggtcattcaagtcagccaatttaccatttttaccatattggatgatacgtcctggtgcgtcaaaaagtacgtctggagctgttcctgcttcgatggctgttgtgattttttcaggacctgacttgaagtcgatggtttccaatttcacttttatatctgggtttgctttttcaaacgcttcgatgattgatttttcataagttccaacaccgtcaccagttttttcttgggtaaatactgggaatgcccaccaagtgatttctgttttggcaccgtcaccacctgatttggcagcatctttacttccgccagaattgccacaagcagcaagaccaagaaccgcagcacccgcaagtactgtacaagctaattttctaaatttcatctgtattctcctatgtaataagcgtatccatattggataatgagtaagattgtatttgtatgcgttttcatttcatccgatgcatccaccactctcctctgttttttattaagtcagtaagtacttatactcttcgaaaatctcttcaaaccatgccagcttcgccttggcgtactcaagtatagcctgcgcctagcttcccagtttgctctttgattttcattgagtattaatcatctacacctaaaatttcattaatactatttttatataagattgcttttgctccatatattgcttgaataccacccttcacttctaagacatcaactgcaccaatttgttttaaaagtgctttatcaacttgatgaacttcttttacagctacacgtaaacgtgtcacacaagcatctacatcttctatattatttgatccacccaacgctctgataatttgtaggctatcctgttttaaatgatctgcagtatttgaagttgaatctgtggattcagaaatttctttagaatctacttcttctcctcgtcctggcgttagaacgttgaattgagtaatgaaccatctaaaaacaatataatacagaacactccaaataagtccaaatggaatctgaagaacccaattcgttttagcgttcccctgcaaaattccaaataaagtaaaatcgattacacctcctgagaatgtgtttcctattgaaatatttaagacgtctgcaataaagaagctgacaccatcaaggaatgcgtgtacaacatatagaaccggactgacaaatagaaacataaattcaattggttctgtaataccggtaataaaagatgttaaagcaactccaaaaaacagacccgcgtattttttacgacgatttttaggaacactatggtacatcgctaaacaggcagccggtaaaccgaacatcattgttgagaaacgacctgcaaaaaaccttgttccttctgtaaataatccagaatgagtcgggtcggctaattgagcaaaaaatattttttgagctccaaccactgtttgtcctgcaacagtttcaacaccaccaagttcagtataccaaaacatagggtaaatcatatgatgtaagcctactgctccagaaagtctcattaaaaatccatatagaaaagttccaattggacccgcctgagaaatatatccacctgtagaaacaagaagttgttgaaaaggtggccaaataacaaagaagacaaagccaattaagatagaagagaacgatgtaacaataggaacgaagcgtgaacccccaaagaatcctaaagcggaaggtaattgaatattgttatatcgattgtgcaaatatacggcaactattccgacaactaatgctccaataactccagtatcaattgcagatccttctgccataaaaagttttaccagagctttaatcgttgcagtcataactaagtaaccagttactcctgctagcgcagcggttcctttatctcgtttcgctaagccaatacataatcccacacagagaagtagtgataaattactgaatacaacctctcctgcagagctcattacttggaatattgattgaaaaaaactattgtctagtattggataagttgctatcgtggttgggtttgaaagtgcaccaccaatccccaaaagtagacctgctgcaggaagtatagctataggtaacataaaagcttttccaactttttgtaaaactttaaacataaaattcccccttacatcttatttgagaccagcaacaaagcgttctgtaatctcttttggtctagtaatagcgccaccaacaacgatgcctcgcactccgtatccctggatttgtttggcttgttctggtgtatggattttcccttctgcaatgacatctacaccagcatcacagagttttttgattaattcaaaatcgggaccatccacttttggactgtaagatgtgtatccagataaagttgttccgacaaagtcaatccctgcttcaacggctgccaatccttcctcgaaagtacttgtatcagccatcaagagctgatgaggatatttctccttaacctgacgaatgaactcttgaatctccaaaccatcgtagcgttcacgcttggtacaatccagagcaattacctctatatcaagttctgccaattcatcaacttctttcatagtggcagtgataaaaggttcttgcggtggataatctcgtttaattatcccaatgattggaaggttggtaacctccttgatttccttgatatcgcgaacactatttgctcggataccgactgctccaccttgctcagccgctttgaccagcaagggaatgactcctcccgcttctgtataaagcggttcgtgaggaagggcctgacaagaaacgatgattccatctttgatttgtgcaatcaaggcttctttagtaatctgtggcatcctctttcctccttttctttgttcttatgagttcattatatattagttttaaagcgctttcaataccttgtggtagaatagatttcagtttcaaaagtattttatagaacagctgtttctgaaagtagtttcagagaaccatctatattaaaacatttttactgaactataaaaagagagctactgggctctctcattcatcattttacatacttaaaaggaatctcactaccacatagccagttgtagacttggtcattgacaaagacattcatgacttcgtgagcatactcaggcatgatgcgataggccttatcgcaggtcagccggttgtaaatcgcaaactgggtaataggatagcaaacatcatcgtccaagcccgtaatcatcttaacctcacccttgatacgatgggcaagatttttcacatcgatataggcaagggtcgctatgatttcctcctcagtttcgtggaagggatcgtgaaacttgaaataacggaacagttcgtcgtaagcctcgctagtattaccaatctcaagcactcgtctaaagtctgacaagaagggataaatggcaactgttttatgaatccgaggattgagtgctgctgcaactagagctagagcacctccttgtgaggcaccatagctagaaagacgcttctcatcaacctgagacagactggcaacaatttcaaccaactggtaaatatccagataaacatccttataaaagaggtgatcccgaccttccacagccccacggatgatatgccccttgaccgtatttcctagaggagaacgcaagctgtcttgtgagtaacccgactgcccccgcacatccatggaaacaacaccgtaaccagctacggtgaaggccagcatgtcagcccagtcccagccacgtcccatataaccatgaaaatggaagattatcggaaccttctcgtcactcttcggaagaacgacgcgtgcatagaccttgccttcattggttccttcaaaggttaattcatagcactttacttgaggaatgtggaaattcctttcctccaactgataagctggaagattggaaacttttttcacttcctcatcccaaaaagcatcaaagtcttgtggaacctcgtcccttcctagataggtcttaatttcttctaataaagctggatttttcatagcatgctccttttttgtaatcgctaccaccactctagcatatctagaaaagcaatgcaagaaagaagggtaaatagaaagagattttagattctttacttttaggatgatgggctgaaagtagttttagaaacgaaaaaagagcatttcgctctttcttccttctatttatattattttgttgcttctttcttctggaaagtggtttggtaatttactttaatcgttactgtcatatgagagtcctcgtttctttttgatgactctagtataaagggcaaacctgaaagctagcttaatactcttcgaaaatcaaattcaaaccacgtcagcgtcgccttaccgtactcaagtacagcttgcggctagcttcctagtttgctctttgattttcattgagtataagatttccttagagaaagcttaatctagatgttctttcttttccaaatgaagggcaatcatgcgccattccggatcctcttgccagccttctattgaactaatgtagctagcaacttttctggcttcttctaaaattgggaaatcttcgataatatcagccacttggaattctggaagacctgactgtctagttccaaaaatctcacctgaaccacgcattttcaaatcttcctcagcaagaacaaaaccattggtggtttctgtcatgatgcgcatacggtctttcccagaatccgtcttgggattggcaacaagaactgcataggactgcttatctccccgaccaacacgacctctgagctggtgaagctggctgagcccgaagcgatcggcatccatgataatcatgacggtcgcatttggaacattaaccccgacctcgataaccgttgtcgaaactagaatatccgttttttgctctttgaactcctgcataatctgatctttttcgtcactcttcatcttaccatgtagaagagccacttctgccttacctgcaaaatgagccgtcaactcctcagataaggcaatggcatttttcaaatccagagcttctgattcttcaatcaagggagagataacataggcttgagaacctttttggatttctccctctaaccaagtcaagacctgaggtagttgctcatgtttgatccagcgcgtcacaataggcttcctccctgctggcatctggtcgataatggaaacatccatatcgccaaaggctgtgatagccagcgtccgtggaataggagttgccgtcatcatgagaacgtcaggattgtcccctttttcccgtaaaatacgcctttgccccacaccaaaacggtgctgctcatcgatgataatcaagccaagacgagcataatccactccatcttgtatcaaagcatgagttccgataataaagtcggcctcacccttggcaatggtctccaagacttctcttttttctgcagcttttaaggaacctgttaagagagccagtttcaagtctgggaagagactcttcaaactctcaaagtgttgctctgctaagatttctgttggcaccatgagggctgattggtagccagctgtcaccgccgcaaacatggccaaaccagcgactactgttttcccactccccacatccccttgtaggagacgattcatgtggtggtcggacttcatatcagttaaaatttcctgcaaactcttttcctgagcttgggtcagggcaaatggcagactttctttaacagctgacactttttcctgagaccagtccagaaccagaccgcttccctgaactctattttcagatttgagcgtttgcaattgcatttggaaataaaagagttcctcaaacttgatacggcgaagggcctgcttgtattctcccaaatcctttggaaaatgcatagctcggactgcctgacaacgggacatgagtttgtatttgtccagcaaggactggggcagattttcctctatcaagaggtccaggccctgatcaaaggccgttttgatgaccttgaccagactggcttgactgattccctgagtcagacgatagacaggctggaggtcatcttccacctgagccaggaccttcatcccagtcagactagccttggcacggtcccattttccaaagacggcaagagttgctcccaactctatcttatcagccagatagggctggttaaagaaattcaccgcaaaaacaacttctccctgcttgagactaaaacgcagtcgattgcgcttgaaaccataatactgaacactagcaggagtcacgacttgaccagacaaaaccgccttttctccgtcttccagctccagcacctgcttggttttaaagtcttcgtaacggaaaggaaagtagagcaagaggtcttgcaagttttcaattcctagtttggcgtatttttctgctgactttggtcccacaccaggtaagacatgcaagggttgatgtagattcatgctccactcctttcttttctaataatattctctcggaatgcggtcgctgagaagacaaaccacctcatagttaatagtcccacggtaggtcgctacctgagtagctgtaatttccttgtccccgttagaaccaatcaaggttacctttgttcctaagggataaagcttaggcagacgaatggtgatttggtccatcgaaacccgcccaacgattgggcaagcttgcccatctaccaagacagcgaaattttgcatatctcgtgtccaaccatccgcatagccgattggcaccgtcgctatgacttgctcgctatccgcctgataggtcgctccatagcccatgcaagctccagctgaaactgtcttgacatgaaccagagcagattccaaggtcaaggctggtttcaagtcataaggtaagtccaaaacctctccgctaggattaagaccatacatggcatcccccatacggaccgcattgaaaatagtctctgcatgccaaagagtcgttgccgaattgctggcatgtatcagctctggaagacctttcataccggctaaaatagttttaaaccgttctaactgggtattaaagtagtcatctgatttctcgtctgcagtagcaaagtgggtaaaaatcccttcaacacgagcaccatgttgttggagcaagtcttgagcctgctcagcctcatgagcctctcgaaaaccaatccgtcccattcctgaatcaatcttgaggtggactgttaatccagttaagtccgcttccttatctaagagtgcttgaatccactccagtccagctacagtcaaggtgatgtcatattctttagctagagcaacaacttcgatttcagaaactcctaaaataaggattcgcttgctgagtccagcctgtctgagttcaatagcttcatcgatattggaaacgcaaaagccatcaacatcatcttgaatagtcgtggcaacggcaacagctccatgaccataggcattagccttgactactgcaaatttgagtgttccttcagggatatgagcccccatttgctgaatattttgtcgaatagctcccagatgaatcagagccttggttggtctatgcggactagctttcatgattttcctccaaaatgacactggctgtcacaaactgatctgtatggctgatagacagccaaatctttcctgaaaatggtgactgactaaaataaggcgccccgcgttcattattcaagacttctaaatcttgaaaaccgagcttgccaataccagttcccatagccttggaaaaggcctccttagccgaccagcgaccagccaaatattcaatctgcctgcgccctttgagactggtgaagcgctccatttccttagcggtcagcacgcgcttagcaaagccttcatgtcgtgtaactgcgctttctatcgaagccaattcttcgatgtcaattccgtgtccaactatcattctcatcaaaaggagttgagatcccccaactccatccttttcacttattttgtcaaggtagcataaatctcttctaccaaggcctctgtattttcccaacctagacaaggatcggtaatggagcaaccaaagacctctggttggttttgacgaccatctgctaggtaagattcaatcataaagcctcgaactatctttttaatcttctcattccagtcacgattttgcaaggtctggcgaacaattcgaatctgctccatatattgcttgcctgaattatcatggttggtatcaatgagaataaagggattttcaagtcccatggcttcatagcgttcaatggcatttagcaaggtttcatagtaaaagttaggctcatttttcccatattcattaactgcaccacgaaggatgacgtgagccaagggatttcctgaagtctcaacttcttgaccatggaagaggaaggtttgtttgttttgggcggcatagataccgttaaacataacaccaagattcccagaggttggatttttcatcccgactggtgcatcaatccctgaagccacaaaacggtgctcttggtcttccacagaacgagcccccacagcatggtagctgaccaaatcatctaccaagaccaaatttgacggataaagcatctcgtctgccgttgtcaaacctgtctctgtaatgacgcgatagtgcaactggcgcacagcctgcaaaccgttaatcaggcttggagccttagaggtatctggttggtgaaccagacctttatagccgtctccgttggtgcgaggtttagctgtataaacacgcataaccatgaaaatcttgtccgccaccttcttctgcaaggcggataaacggcgggcatattccaagacagcctcttcattatcagaagagcaaggaccaatcaccaaaaggatccggtcatcttctcctgaaatgatgtctgccatttctctatcacgacgctcctttagtcgcaaggcttccgcagacaattgggtttctgctttgattgcttcaatatcaatttcttgacctttttcaataaatgccatcttattctcctagcgtttggtagatttctctgacgagggcttccgtattatcccagccaagacaagggtctgtgatagacttgccaaatacttccggttcgttttgacggccgtcttctagataagactcaatcataaagccacgaacgtactgcttgattttttcattccaatcacggttaatcaaggtctggcggacaattcgaatctggtccatatattgcttaccagagttgtcatgattggtatccacaatgataaagggattttccaagcccatcttctcatactgagcaatggtatccatcaaattatcatagtagtagttaggaatattcttaccatactcattgatcgctccacgaagaatggcatgcgaaagcgggttcccagttgtttccacttcttttcctaggaaaaggaaactttgtttgttttgagcagcataaatcccattaaacataacattgagatttccagaggttggatttttaaacccagtcgcaaaatctgccccacttgccacaaagcggtgttgctggtcttcaactgaacgggcaccaaccgccatgtaagaaatcaaatcatctacaagcggaagattttcaggataaagcatttcatcagctgtcgtcatacctgtttccgtgatgacacgatagtgaagatggcgcacggctttgattccgttgataagactaggcgcttctgtcgcattaggctggtgaatcaagcccttatagccatctccgttggtacggggtttggcagtataaacacgcataaccataaagatacggtctgctacttcttcttgcaaagctgccaaacgcttagcgtactcaagaacagcttcttcattgtcagatgagcatggcccgattaccaagagaatccgttggtcttctccacgtataatggcttctagctcttgatcacgctgtgattttctctctaaagcttgaccttctaattttgataaggcacgaacttcttcaatattaattttaggactttttgctgtaaataccataactcatctccttataaagcaaacggataccaagtaaaaatttacttttcacaaggtatccgcctctaaactatctcattttattgtcttttaccgtgacagtttttaaacttcttaccagaaccacatgggcaaagttcattccgtccaatctgactcaaatccaaatcttctggtatatttgcttggtgggcagcgatattgcgggtcgctgttgtactgatatggtgttctgcttgtggtctttcttgttcatgaatttgggctttcatcatcaaacgtgtcacatcaaactcaatcgaaccaatcatatcattaaacatacggaaaccttctgcctgatactcaacaacagggttgttctgagcataaccacgaagtccaaccgcattacgcaattgatcgagggcatcgatatgatctgtccacttgttatctaccactcgtagaatcaagactttttggaattctttaactgcttcttcatcacgtagttttgaaacctgactatcataaacttgcaaggcacgttggaagagttcttccttaatagccttatcagacaagcctgacaagtcttcgattgcaatcgaatcttcaggaagcaagttgtacttagcaaagttcaaaattgcttctagtttttcatcttgtttcgcacgcgcatgaccatcaacgacacgaccaattgtacgtttgatcatagcctgaatttcgggtgccaagtcacggtctgcagtgatgacatcgtaacgttgagcgtagataatctcacgttgttcacgcatgacatcgtcgtattgaaggacttgtttacgagtatcgtagttatttccttcgacacgtttttgtgctgcttcaacctgacgcgtcaacatacgagactcaatggcctcttcagacatattcaagcgttcaaagattcccttcaagcgttcagaaccaaaacgtttcatcaaatcatcttcaagagataggtagaattgtgactcacctgggtctccttgacgacctgaacgtccacgaagctggttatcgatacgacggctttcatgacgttctgtaccaataacacaaagtccacccaattcgcgaaccccttcaccaagcttgatgtcggtaccacgaccggccatgttagtcgcaatggtaacagcaccacgttgaccagcattcatgatgatttgggcttctttatagtggtttttggcattcaagacctcgtgaggaacgccagctgcgactaatttcttagaaatatagtcactggtttcaaccgctactgtaccaaccaagactggttgacctttttggtaacgagccttaacatcttcgacaaccgccttaaacttagcctcgatacttgcataaagaaggtctgagtggtcaatacgttgaacaggacggttggttgggattggaataacacgaatgttgtaaatttcacggaattcttcttcctcagtcttacctgtacccgtcataccagacaatttcttgtacatacggaaaaggttttggtaagtgattgaggcagatgtcttggtttcatcctgaattggcacaccttctttggcttcaatagcttggtgcaatccatcagaataacgacgaccttccatagtacgacccgtaaattggtcaacgatcaagatttcttgttcttcgctcaccacatagtcaatatcgagaagcataatgtagttggcacgaagggcgttatcgataaagtgagtcagagctacgttttcgatgtcatagagattgtcaagcttgaagtagctttcagccttgtcaatccctgaatcagacaaaccaatagtcttagactgcacatcgatgatgtagtcgtctttgtccaaagattttacatagtggtctgccatgtggtagagctgactggtttcaactgcattagcacctgatacgatcaaaggtgtacgggcctcgtcaatcaagatagagtcaacctcatcgaccaaggcatagttaagcggacgttgtaccatgttttcagcacgaacaaccatgttgtcacgaaggtagtcaaatccgatttctgagttggttgagtaagtaatatcacactcataggcttcttttttctccattggagatttggcagccaagttaatccctactgacaagccaagccaagaatacaattcacccatctcagtcgcatcacgttctgacaggtattcgttaaccgtaactacgtgaacccctttacctgaaagagcattgaggtataccggcatggtcgcagtcaatgtttttccttcccctgtacgcatctctggcacgtcaccatggtgaagaacgattccccccattacctgaaccttatatgggaagagacctaggacacgtttggcaccctcacggacaaccgcaaatgcttcataaagcaatgaatccagtgattctccattttgataacgttctttaaattcaactgtttttgcttttagttggtcatctgtcaaagcagccatttggtcttcgtatttgaaaaccttgtcagccatcttttccagacgacggatttctcctttatcattttcgataattgtttttaaaatattagccatgtttttccttactttaaattccgaatattttagaatgttcttttaattttagcacaattactgattattttcaaggaagaatccccattttgaaaaggaaaaagaggctagtttccaagctaacctctctgacttttatgatactttaattgccaaaaatcggcaaaatcgcaaataggataaatagattaatccaaagagaaaaacagcagatcaatccaaaaacaaagagactgactttcttggacagcaaggccatcaaaatagacagaataccaaaaactagcaagactttctgtatgctgaagaggtcaatctttccccccagaatcggactgccccaaggaagaaagaagaaagcaatccagatcaacagaactaaaccaatatagaccttagaatagcgtgtaataaatgattttagacgtgtcataagctacctcctatcaataaaaaccatataaatcaatgcctttcgcctttagattgtcctagttcccgtctcaagcaaaacatgtttttgaaaaagatatagtctaaccagtcactgcctagagataagactatcaaaagcaaccaaacaccccaagtactagcatctgatacataatttagaacaaaagggaaaaataagaatgaaaaaattgtcatatccaagctaaacagagctaaaagggaaatataaatccagtagaaatagtagataatggggaaaaacttactgtttctatcagcattatctatccaaataaaaaaagtaaaagcagggaaataagagtatcaaatgaaaccaattaaacgacagtttcatcatcgacacctcctctttaaaattgttttctttagtttcattctattaaatgttcttaccaatataaatcaatgctttccacctttagacttccccagttcccgtctcaagcgaagcatttttttgaaaaagatataggttaaccaagaactggaaaaagcaataagtagtaataatagccaaatgccccaagacttgatgtctgccacatttctcaataggatattgaaaaacaagactgaaaaaactgtccaagcaaggctaaaaagagcatagagggtgatgtaaatccagtaaaaatagtaaaaaattgggaaaaatttactatctctgttggccttttcaatccagctgaaaaagtaaaaacagggtaataagattaacaatttaaacaaatgttccatcatcaacacctctttttgatagcgctttcttcaacttcattttatcaaaaaaatctggaaatgtcattccagattctgcttttttatttacgttttcttgcgatgagatgaatcggtgttccttcaaagacaaaggccttgcggatttgattttccaagaaacgcaggtaagaaaagtgcataagttcttcttcgttgacaaagataacaaaggtcggtggtttggttgccacttgggtagcatagaaaatcttgagacgtttccctttgtctgtcggtgttgggttaatggcaatagcatccataatcacatcgttcaagacggctgatggaatacgtgtattttgactttcgctgatttgcttgatcatctcaggaagtttgtggagacgttgcttggtcaaagctgatacaaagataatcggtgcgtaaggtagatattggaactgctcacggatatcttcttcccagtttttcatagtgtggttgtctttttcaagtgtatcccacttgttgaccacgataatcatccctttaccagcttcatgggcaaatcctgcaatacgcttatcgtattcacgaataccttcttccgcattgatgaccatcaagaccacatctgaacggtcaatagcacgcatggcacgcatgactgagtatttctcagtattttcataaaccttaccagatttacgcataccagccgtatcaatcatggtaaactcttgaccatctgtatctgtaaagtgggtatcaatagcgtcacgcgttgttccagcaacaggactagcaatgacacggtcttctcccaaaatagcgttaatcaagcttgattttccgacgttaggacgaccaatcaaactaaacttaatgacatctggattttcttcctcatattcatttggaagattttctacgattgcgtctagcacatcccctgtaccgataccatggacagatgagattggcagtggttcacccaaaccgagggcataaaaatcatagatatcatttcgcatctcagggttgtccaccttgttaactgcgaggataactggtttatgagttttataaagcttacgagctacgtattcgtccgcatcggtaattccttccttaccagacacgacaaagacgataacatcggcttcttccatggcaatttctgcctggtgcttaatttgttccatgaaaggagcatcgacgtcatcgattcctcctgtatcaatcatgctaaaagaacgattgagccactcacccgtcgcatagatacggtcacgtgtcactccttcgacatcttccacaatggagattcgctcaccagcgatccgattaaatagggttgatttcccaacattgggacgtcctacaatggcaatagttggtagggccataatttctcactttctacaataacttcttctgttcaagattttttctagttgagcttggttcagctcgaccaaactgttctgctagacgttgactccagcttgtggtcgcacgcgccccagcatagtctgtctgcacacggtcataatctttgatgatttcaacagattgctcctggtattcttcctcaaataccacttgattcaatggcaagcgaggtttgacttcatgttcttcatttgatattcctagtgccatcccaaagacaggataggtgtagtcaggcaaattaaagagttctgctacttcttctgacttgtaccgcaccaagccaatgatgacacctccatagcccaaactttcagctgccagcagggcattttgaccagcaagggccgcatcgaccgaactaatcaagagaccttccacaccttggggttggaatgtatcggtatggagtcgtgctcccttttctgcacggttcaaatctccgataaagagaaggaaaacagctgactggcgaatggcttcttgaggcaccaattcatacaaggcatctttcttctcttgacttcgtaccacaatcacagagtaggattggaaattcttccaagacgaggccatttgggctgctgtcaggatttcagtcaagtcttcctgagggagggcttgctctttaaatcttcgaacagacttatgagctttcatcagtttaatcgtttctgtcatcgacggtttactccttctaaacgagtctcctcagccaaataacggatgcgttccatgacgcgtctggcttcccaggtttcgtcatttccatgtttccctttagcgaaatgctgctccaattcttcaaagttgaagttggaggtgaaaaaggtcggtaaattttcctgcatccgatattgaagaatgacctgcaggatttcatcacgtacccaagctgttgattgctcggcaccaatatcatctaaaatcaggacttcagaaagcttaatctcatccaccaaggtcttgacattgccatcaccgatagcatttttgacatcaatgacaaagctaggatagtggagcagagtggatgaaacaccgcgtttttctgataaatcatgggctaaggcagccaccatgaaacttttacccacaccaaagtctccatataagtaaagaccttttcgaatagctggatattgctccacgaaggctaatagcttttcaaaaactggcaagcgctccaaatcatccaagtcaacttgagccaaactagctttcctgagactggctggcagattgattaacttgagacggttcttaatagccgcttctttttcggccgcgattagttcaggagtttcctcataagaaacgtccgcataaccatgattcataaccaaaataggcttatagcctttggcaatataatccgtatcaccacgaagaaacttatcacgctcggtgatgtactgattaaacttggagatactgcgattcaattcctctgggctgagggattcttgctggataaaggccgcaacatcaggatccttcatgattttctggaccaaatcttgataatgaaaacggctaggttgacgtttgagtacgtctccgacactttccatctaatctcctcctttttctaatcgagctaatagttcttgtttcttacgttctagttccagacgagtttcctcgctggtttcattcttataatctggattgctccacttgggtacattggacttggtaggactcggtttactgcttttttgagcctgattcttctgtcctcgctcacggatgcgtaagaccgcctcttctgccgaatgtatcttttgataggcatagtcattggccactttcatggcatatttctcattgatatttgccgaatcgaccttattaaaggtcaataagagaatgatattgatgacttcgtccagcaaacccaagccagccatctgttgcaagaggtctctttctgtttgggtaatggtccccttgcgtgtttgcttgatttctgccaagaactgcagggcagttttacttttagcctctttgataatggtcgtttccttaggactaaagtcagaggaaacaggtttttgagcaattttttcccgcatacgcttggttgaaataacctgggaaacagctgttgacttagccagttgataggtttcaaaccaagtccatttcttctcctcagcgatggcaaagaggttcaagacatcggactgctcatctgcaaaacgaagtccatctcgagccataagctggcgaaaatggtccaagtcaaaatcgttggccactttcttcttgagaccaaggtcttcttgacttccctgttctgccaagtctggaaagacttgattgagtgagacaggtatttcttcaccatcagcactttcaactttcaaatcctccacagccgagtcgccaatctttttctctaaaagtctacgataaacaggatgctccaagaaatcttgacttgaaagaggagcatggataactatctgataggtatcacccttttgatagagggtcaagagattaaaagcagataggattttcaaagattttaaaagtctgtccatcccaaaattgagatgattgagaatgcttgaaaaaaggtattcctttctgccattatcccaaaaactaatcgtataaagataaaggctcagtgcctcctgaccgataatcgggaggtagcactgtaccagagatgaggtatcttgcgacacccgattattctttagataagaaaaacggtcaattggcttcatttatctttcctttttctttttagaggactgggtgatttgttggagcaggctctctaactcactaacatccttaaaactacgatagacactggcaaaacgtacataggtaatctcgtctaactcagccaactcctccatgacgagtgaaccaatgtcctcactttgaatttcattttcatttcgaccacggagtttctgttcgatacgattgactaccatgttgatttcatcacttgacacaggacgtttctgggctgagcggataattccattaaagattttatctctagagaattgttcccgtgtgccatcttttttaacaaccactaaggttctttcttctactcgttcgtaggttgtaaaacggtgctggcattcatcgcactcacgtcttctacgaatagtgttcccttcttctgcttggcgactatcgataacacttgacttggtagccccacattttggacaacgcatcctttccctccttatcgttttcttttcattataccattttttaaacgattcccaaaacaattcttctttttgcttgacaagttttttgttttgttgtattatttaattaagacaaaaggataaaagaaaggagaccaagatgtcctggacatttgacaacaaaaaacccatctatttacagattatggagaaaatcaagcttcagattgtttcccatacactggaacccaatcaacaacttccaaccgtgagagagctagcaagcgaggccggtgtcaatccaaacaccatccaaagagccttgtcagaccttgaacgagaaggatttgtctacagcaagcgcacaactggacgatttgtgactgaggataaggagctaatcgcccaatcgcgcaaacaattatcggaagaagaattggaacacttcgtttcctccatgacccattttggctatgaaaaagaagaactaccaggcgtagtcggcgattatattaaaggagtttaagcctatgtcattactagtatttgaaaatgtatccaaatcttatggagcaacaccagcccttgaaaatgtttctcttgacatcccagctggaaaaattgttggtctccttggaccaaatggctcagggaaaacaaccctgattaaactaatcaatggcctcttacaaccagatcaaggacgtgtccttatcaacgatatggacccaagcccagcaaccaaggctatcgtagcttatttgccagatacaacctatctcaatgagcaaatgaaggtcaaagaagccctaacctacttcaagaccttctataaagatttcaatctggaacgcgcccatcatctacttgcagacctcggcattgatgaaaatagtcgtctcaagaaattatcaaaaggaaacaaggaaaaggtacaactgattttggttatgagtcgtgatgctcgtctctacgttttagacgaacccattggtggagtggacccagcagcccgtgagtatatcctcaataccattatcaacaactactccccaacttctaccgttttgatttctacccacttaatttctgatatcgagccaatcttagatgaaattgtcttccttaaggacggaaaagtcgtccgtcaaggcaatgtagatgacattcgctatgagtcaggtgaatccattgaccaactcttccgtcaggaatttaaggcctaagtaaaggagattattatgttttggaatttagttcgctacgaatttaaaaatgttaacaagtggtatttagctctttatggcgctgttctcttcctctctgttcttattggaattcagacacaatccttaatcaaactacctgaaaaaaatctatctgttctacttttttttctatctactgtctttggtggtttgatggttacacttgtgatttcaactatcttcttgattattaaacgattcaaaggaagtgtctatgaccgacaaggctatctgactttaaccttgccagtttctgaacaccatatcatcacagccaaactaatcggtgcctttatctggtcgttgattagcactgctgtcttactcctatgtatctatattatcttattgtcaacaaattctgatgcagttcaactttctactcttctgtcatttgttgcagaacattttaccggctttagtcttactgtcttatccttcctactaaataccatttctggaatcctctgcatctacttggctatttccattggacagcttttcaacgaataccgtaccgcactcgctgttgtagcctacattgggatccaaatcgtcataggatttattggagttttcttcaataccagtactaacttctatgtcaattcacttgcaggatttaatgataatttctatatgggagcaagtacgggcatttttgaagaactcatattcatagctattttttacctcggaacctactatattttgaaaaacaaggttaatttgcaatagtttttaaataatttttacctagatatataacatactcataggacaaaaagtctttaaaatcagaaaacgcataatatcaagtgttaaaaatccttgatattatgcgttttattgttagaaaatttgctttattttctcctctaattgagtttttgcccagcctcaaaacaccaacttcattttacctaccaagcacagtcattcgtcatttattttttccaatattatctacgaactttgataaaaagagaggtaccatagctataaaaacttgccctctttctccccatgcaaataaaacgactgcaagaacagctgaaaagattgctaaacatatagatattagacgacatattttcttattattcatagcactgctcctttacttcataaatattttacaatagattttagttgaaagtataaaagaaaccccaatcatgatactggccaaaattatgatacttataactagaaggaaatgattagctgaactaatccagttaatgaaaatcatgccgaaagtcgttttctgaagaccatacactaatcccataactaacgatagtaccagtatattgacaatcgtatttccaaaagcaccaaaggcatatacggaaggaagcaataaggctacatacatgattccaaagattattccaatcaatgccataattaaatgtagattgagactgtattgattaaacatgacatgggtagcaagacttaaactcaatactatagaacttaccaaaagaataaaagaaatacaagagagatacctcgctaaaattatcttagattttgaaattggaaaaactcctacaaattgattccaaccattctcactatctgatacaactaaagctgtgggaagagaagctaaacttattggtaacactattagtaaaaaaattgtccccgattctcttgcaaagattgtaattaagaataaggctaaggcaataaatattctattaattatctttactttatttaaaataagttgcgcatctttatatagtagtcctttcatttattcgttctcctttgactaaaaataataaaatttcccaaagcgttgcataattactctcgtccttactcttgtcagatacaactactaaatatcgaacactatcaccctcttctaatttataataaatgtctacttgatccatattgttctttatttctgttttaatcataaatcggttcagtaaattttctctgtctccctctagaagaatctccccattatggataaaaataaaataatctgccgcctgttctaagtcactcaaaatatgtgaagataagattacggtcatattctcttttttaacatactcttctaaaatagataagatctctcgcctaacaataggatccaagccacttgtggcctcatctgcaattaatagtctcgggcgatgagcgagtgcagacgcaaaattaagtttcaccaccattcctctggaaaattctttcatctgtttttgagatggtaagttaaacttttgaataaaagtgtaaaataactttttatcccaactaggataaatcatgctcatcattctttcaacttgctccaccgaaaatgaaactggaaaaaagttttgctctaagacaacccctagtttcgatttaatatcttgctcatgctctgaataagtttgttcaaaaacccttatactatccttctcaatctgtagttgatttaaaatcagattcagtaaagtagatttaccagctccgttttcaccaatcagtccaataaccttaccttctggaatctctaagttacggacttgcaattgaaaatccccatactgcttggttaaattttttatattaactattgatctggctctcatgttaacacctcatctaaattataacatcatgtataaaatcgttaagctattccctaaaaaaataagactcgccaataaaatattaactttatttggcacattaagtttttttaattccagtaacaacagcaaagaaactagaacatagttaataacactaataaatataaaatactggtcagttattttcgttcctaatcgtattctaggtattagacacgtctggcattactaaaatttcttaactgcaaaaaaacatgaaagtcttaattattaggataaacttactaatctgccttcccaacatcaagacaattggacttcttttgtgattgcactcgaatctccaattgtttattcttctgaataaactgttggtaaggaattgtattactaaacgtaaaaacacctagtaatgctaatatagctaattttttaattccgcgtttttttctcttgcactgaaacccctttctgtttccttatttttattctaacatatatattttaattagccaattgtttttattgtattttgaacttttttttcttattattaccataaagaattttttattcctttaacttgctattttgaactaaaaattttataatgaaattaagcaaataggaaggattattatcttttatgaatacactcgctgagaaattcagagtaaagagaaaagagttaggtctctcccaacaaactcttgcagaaggaatttgtgaacaaagccagattagtaaaattgagagagggcatttcattccctccgcagaccttttgttcaaactctcacaacgacttgaagtaccattagattatttttttaatgaacaaattgaaattaaatctaacctctctaatttcaagcaattatctgctcgactattagatgacagaaattatgacgatttggaatatatttatagaatagagattgagcgaagcacctttctaacactagaagaccgaacttaccttgaatggattaaagctattattgacttctatcaatatgacagtaagtgtgaggcaatttcttcattggaaaatatattattaaaagtctcttcaaatactctgatttatttaaaggcgttgaatactctatctaatttctattccttagtgggtcgtgaacaagaatatgaggcaaactactctcatttgatggagttatatcagacaaaaaattttgagcatcaggagtttttatttggttacatcagagttcgttacaactacgctcactacctagtatcaaaggaaaaatataacgaagccatccaagaagctcttgagacgattgaactctgtaaacaaagacagacaagctaccaactggctcctctacttattcttgtaggaaatgctggagccaaatttctagacaaagaacaagtcaaaaattattatatagaagcaagagagttatgtaagatttataacaatcctttaatgttgatgaagatagaaaattatttgaaggaattagatactgtttaatttatcctatcattagaattcttcttaaactttgaataacccctaaagctaataaccagcttgattcaaattcacttcataaattagtggtattttgaggttttattttatcaagtatgttggcaaatttctctaatcttctaacttcattatagaactttaggtatcaaaagaggctgggacaaaagtctaaccttaaatataaaaagcgaacaaaacgagttatctgaaacttagaattctgttttgttcgcttttttatctaatctatcgattttaaaattttataataaagaattcctaaaatcaaaatctttttgtcccagcctctttttaactcaatatcaaactggctacaatggggctgacaaagacatagagaataccggtgacaccgatagccaagccacccatggctcctgctacagaaccatatcgaaaggctgtccctgttccgactgcatggcctgttcctccaagggaaagaccaacagctactgggtcgtcaattttcaaccacttcaaaagggttgggccgatgacactggttaaaatcccagttgccactacaaccaccaaggtcacggtcgtcagaccttgcaatttttctgtgattcccactgccatggcggttgttactgacttgggaaagagagaaatggctaggaaaaaatccatgccaaagattttggccacaagggctgtgaaagaggtattgacaactactgctagcagactaccaaagagaatactccgagcatggtgcttcatcaagtgaaaactcttataaaggggaatccctagagcaacagtcgatgggacaatcaagttgttcagataaaccccaccttggtagtaatcttggtaagaaatacccgtcacctttagaaagatgataatgaaaatagctgacaaaagcaagggcgttgtcaaaggatggggaaaacgtctgtaaatcagcattcctactagataagctaggatagacagggcaagcccaaacaggggattggaaacaaattcactcatttggcatctcctttctcataatctccctcaaaccgtctcttgatgaactgaactaccaaggctatgaggataatattgatgacagccgcaaaaaagacaatcaaaacaatgggcaagagatagggagcaatcacatcaaacttctccatgattcccactgctggtggcaaaaagagaatggtcatattggccagcaagaaattccccaccatattgacatgtctggttctcagccacttgaattgtagggctagaaagagaataatcaagccgataatactgcctgggataggcaaatgaaagaaactggaaattccctctccgattagagaaatcacaaagagaatcattaattgaacatataatttcatcctaaactccacgaaatagacttcttgcataccagtttactcttttttcagaaaatttcaaggaaatacacaagggataatgaaaattagaaatggaaaggggatacaaacaattcttgacttgtgaaaactggtatgatttaggataaaagatttcagcgtccttcttgtcagcattcttgaaaagtagtataattattgcatgcgcaatcatcttgtgatacagagactgtccgtgaatggactttcttctatttacaactctaaaaagaaaggagatactatgacctatttggaaaaatggtttgacttcaatcggcgtcagaaagaaattgaaagtctcttggaagagactattgcccagcagagcgagcaaagtctgaccttgaaagagttctacctgctctactatctggacttggctcaagaaaaatctctacgccagattgacctgccagataagcttcatctgagcccgagcgctgtttctcggatggtggctcgcttggaagccaaaaattgcggtctgcttagtcgcaggtgttgtgatcaagataggcgctctagctttatctgcctgacaagtgatgggcaaaagacactggccactctacaaaaggctgtcgaagaaagcttggaaactggtttagatttcttgatttaagatgattttgaaaaaaagttgcgtgcgcaatcatttttcttgacattctcttttacaaggagtaaaataaaatcatcattaaacaaaggagttctaaacatgattgaaattacctatctagatgccagcaagaacgaaagaactgtaactttcgaatcttatgacgactttgatcgttcgcaacaagcttgccttatcggcgtcgcagactactaccctgtccaaaaattaacctacaacggtcatgatttggactaccatgggacttatggagatgtcttcttctatctcatgaaacaagatttaagccaatataactaaaaaaggagaaatacaatggcaaaagcaattacagatgcaacattcgaacaagaaacaaaagacggtttggtcttagtagacttctgggcaacttggtgtggtccatgtcgtatgcaaggcccaatcttggataaattgtctgaagaactttcagaagatgttttgaaaatcgttaaaatggacgttgatgaaaatccaaacacagctcgtgcttttggaatcatgtctatcccaactcttctcttcaaaaaagacggccaagtggtgaaacaagttgctggtgttcacacagcagaacaaatcaaggccatcgttgctgaattgagctaatcaaacgagagaccaagtacttgctttggtctcttttttcttgccctttgccatttttcaaaaaatatgctagactgttagtagaatattacgatgtttgggacatgccatcgctaaaaaaaacctctacttggtattttttagctccctcaagggagctttttgcgtgctctgaacattccccattttggaaggagtactatgaaacgtcaatcagccttggtcgtctttagtggcggtcaagattctacaacctgcctcttttgggctaaaaaacactatgaaacagtcgaagcagttacctttgcctacggccaacgtcatcatctcgaaattcaagttgctagagaaatcgccaaggaacaggggattcgtcatcacatcctagatatgtctctgctggggcaaatcactgaaaatgccctgacctctgatatggagattgagcaaaaagagggagaggttcccaataccttcgttgacggtcgcaaccacctctttctatcctttgcggcagtccttgctaagcaacgaggtattaaagatatcgtgacaggtgtctgcgagacagacttctcaggctaccccgattgtcgggatgtcttcgtcaaatctcttaatgttaccctcaaccttgctatggattacgactttgttatccaaacacctctcatgtggctagacaaggctgaaacttgggaattagccgaccaactcggtgcctttgactatgttcgtgaaaagaccttaacctgctacaacgggattatcggaagtggctgtggagattgtcccgcctgccacctacgtcaacatgggttagatgtttatctctcacagaaaggagaggactaatgttttttgcacccaaagaaatcaaacaggaaactggggagtcgcttgtctacaatcctcacagaaccttggtatcaaaagaatttacctttgatgctgcccaccacctctttcactatgaaggaaaatgcaagtccctgcacggccacacctatcatctgcagattgctgtcagtggatttttagatgaacgtggtatgacctacgattttggagacatcaaagcgatctacaagaactacttagagccccacttggatcatcgctatctcaatgaaaccctgccttatatgaacacgactgctgaaaatatggtttactggattttccaaaccatgaatcaagagttgcccgacaaacgcggtcttcgtttggaatacgttcgcctctatgaaactccgacttcctttgcagagtttagacgggagtggttagatgactagggaacgtgtcctcaaactaccagttctggaaatttttggccctacctttcaaggtgaaggccgtgctattgggcagaaaacaatgtttgtccgcactgctggttgcgactaccactgcgactggtgcgactctgcctttacttgggatggttctgaaaaaccaactcgcatgacagctgacgaagtcattgctgccttggataaactagggaactacgactatgtaaccctgtctggcggaaatcccgctatcctagcagccaacatggctgaactggtcactaagctcaaggaacgtggtgtcacccttgctgttgagacccaaggctctcgctggcaaaattggttaaaagatatcgaccaggtcaccctgagtcccaaacctccttcatctaagatggaagtcaactttgagaccttggactttatcgtttcccaactagatccagacaaggtcacctttaaaatccctgtctttgatgatgctgatttggcctttgctaaagggattcaagaacgctaccaaccagatgttctcttcttatctgcaggaaatcctgagcccaaggccacaggaaatattgtccaagaccaactggaccgcctcaaagaactctgggaacgcgtcgctgctgacgatagctggggcaatgtccgtgtccttcctcaactccataccctcctctacgacaaccaacgtggtgtttaaattagaaagaaaaaatcatgtcacaacaagaagaaatgaaaaacctaagcctcctcggcaacaaagaaaccaactacatttttgactatcaacccgaagtcctcgagtcttttgacaatcgtcatgtggaaaatgactatttcatcaaattcaactgtcctgaatttacctccctgtgcccaatcactgctcaaccagactttgcgaccatttatatttcctacattcctgacaagctctgcgtcgagtcaaaatccctcaaactctacctttttagttatagaaatcatggcgatttccacgaaaactgtatcaacaccatcgggaaagacttggtcaatttgctagaccctcgctatttagaggtttggggaaaattcactccgcgtggtggaatttcaatcgacccctactacaactacggcaagcctggaaccaagtatgaaggcctggcagaacaacgcctcttccaacacgatctttatccagagaaaattgacaaccgttaatactcttcgaaaatctcttcaaacttcgtcaacgtcgccttgccgtaggtatggttactgacttcgtcagttctatccacaacctcaaagtaatatattgagcaacctgcggatagtttattagtttgctctttgattttcattaagtataaatacgaaaaagccctgttcctcaaactgaggagcaaggcttttttagtttcaattattcttctgttccaaggaaatttttagcaacaagtgctgcaagaactccaccaacgattggggcaaggatgaaaatccatacttgttgaagggctgcgccacctaccaatacagcaggagccaggctacgagctgggttaactgaaagtccagtgatgttcaatcccacaaggatcatggccatcaaggacaaaccgattaccaaaccagcaatcgcgccatttcccttgctttctgaagtcacggtcataataaccaagacaaacaagaaggttgcaatcacttcaaacaagaaaccaccaaagacagtaaccccgtttgccaaggcattttcaccaagactagcagttgacatacctgcgttcgacaagaggaagaagaccgcgccagaagcgatgaaggctccaactacttgtccaaggatgtagtttacaagttctgaagatgacaaacgtttgtttacaaacatagcaatcgaaaccgctgggttcaagtgagcacctgaaacagttccgattgagtaagcagcaaccacgatggccaaaccgaaggcaaaggcgattccaaggtgaccaaggccatcaagaccatttccaaaaacaacagctcctgttccaatgaacacaagcatgaaagtaccgattaattcagcaacaaattttttcattttctttctccttttttcaaaaactagatactagtctatcaaaagagggaaagggtttcaagaaaattgattggaaatttcaggttaaaattctgtaaaaacggtagtgtttatttgaaacatttttttcaaaggtgtatactaatagcgtagttttgataggggttacaaaactcattataaaagctcatttgtaaacctttgctgttcttttatgaacgtttgaatggtatcgtgaataccaaggaggaatcatatgtctaaagttgctattgtcacaggtgcaggtcaaggaatcggttttgcaattgcgaaacgattggttcaagatggctttaaggtaggagtcttagactacaatcccgaaacagctgaaaaggctgttgccgaattatcagctgaaaatgcctttgctgtcgtagctgatgtttcgaaacaggcagaagttgcccaagcatttcaacaggttgttgaccattttggtgatttgaatgttgtcgtaaataacgctggagttgctccaactactcctcttgatacaattactgaggaacaatttacacgtaccttcggtatcaacgttggtggtgtcatttgggggtcacaagctgcacaagcgcaatttaaagcacttggccacggaggtaaaattatcaacgcaacttctcaagctggtgtagtcggtaatccaaatctaactgtttatggtggaaccaaatttgctgttcgcggaattacgcaaacattagcccgtgatttagcagactcaggtatcactgttaacgcctatgcaccaggtattgttaaaacaccaatgatgtacgatatcgctcatgaagttggtaaaaatgcaggaaaagatgacgagtggggtatgcagacattcgcaaaagatattaccctaaaacgcctatctgaaccagaagatgtggctgctgctgtcagcttcctcgcaggaccagattcaaactacattacaggacaaaccattatcgtggatggtggtatgcaattccattaagatacacaaaaagaggttggaaaatgattcaacctcttttattagtttttattatcaggtaggaggatacaatagaaaccctattactaagtaatactagttaatccctagtattgaaaagactggatagcttctttcaagtcatcttgtaaactgtttctctggtcaagttggacatagacttccaacaaacaggatctaaagttggaaaatttgtaaaaatcctccctttcttctatcggaaaatcaacagtttttatccaagaggctacttgctcttgcgctaacttcccttgtaaaatcggttcataaagtactctggctaaacgccaatcttcatcatctgtaaaacgaatgggaattcttttaaataatgggccaagtatgtcaaagacttcatgaattctgtttttaggaaagtctggatgacaaaccacctctgtcagtaaatcggctccatgtgcaaaagcatgaacccgaccatactgacttgaaaaacctgttgtatccttttcttttgaaagatagtacaacccttgatttaaaaggacattacgaattcctgcatttaattcctgataaaaaatcgattgctggttggcatcagcagacaagagatttgcataaataagcgccctaaaagaacgttcaagtgttgacaagcctaccttatcaatctccttatctaaccctccatcagatgaaatcccttcagcaatgaaatgaaattgttcctgtgtaaatagctcttcctgaatccctctagcaaagcttgtaaaaacaaggtcatcgcgaatttctggagaagaatctcccaaatgatcaagcaaccattggatttcctcctgatgataacttggtttttcttcttctatttttctaagtaacttttgatacatggtcaatacttctacatttctagcaacttgatataatctagaccccatttctcgacagcatctaaaacaactctgaattcctgccccatttcggttaagctgtactcaactcgtggtggaacttcggcatagacctttcgttgaacaatcttatccttttctaattgacggagatgacgggtcaaaatagtttgagtaatcccaggcaataatctttgcaattctttaaatcgtttggtacccgtactcaactgataaatgattaccagtgcccatttccccgttaaaaccctctgcgttgtcgcaaatggacaaataccatactcactcactttatttgtcataaaatatcctctttctattttttaaaaaaaatttatcttttagtatcaataatagtactacttttgatactagctatcgaaaaagtatctacttgtttttttgtttgtaactgttacaattatatcataaaaaagaaatggagaatatatatgtcaacaaacttagaaattttcaatgcttataaccaagctttaattgctggtgactttcccagtgtctttgaaacgatggcagacgatattatctggcatcaacctggtactcatagtatatctggttcagttggtggtaaggacaagctaggaactcacctggctacatttgctgagaaaactagtggaacctttaaggtgataacaaattgggtttctgacaataaggatttaatcgcagccaatgttacttttcttggaacacgtgctgatggtactgaactcaatatgaacgggattgacctcttccgcattgaagacggaaaaatcaaagaagtttggctcttctcttcagatcaagctgaagaagatagcttttggggataatttaagaggccaggacaaaaaattttgattttaggaattctttattctaaatttttaaattaatagattagaaaaaaagcgaacaagacagaattctgagtgtcagataactcgttttgttcgttttttatatttaaggttagacttttatcccagactcttttaatttactctcccaactgggcactgtaggcgatgatctgatcaactgtgtctgacaagaattggattgtatcacggagtggtttgtctgttgaaatatctgctccgataatcatagctgactcaagcggtgtcttgctaccacctgatttgagaagtttgagccagtcttcagctccagtttctgaattttttagatgaaggtaaccagcagtcgagataactagtcctgctgagtaagtgtaactatacaagcccatatagtagtgagcttggcgcatccaagtcagagccgcatcgtcgtcaatttcaatagcatctccccagaaatctgtcaaaacttccttcataatactgttgagtttgcttgctccaaaggtctccccttcttcaatcaatgtatacaccttacgctggaaggctgcttccaaaaggtgggtaataaagttatggaagtaggtgtctgtcaagcggtgagcaagagcgaagcgtttttgacgtgggtcgtcagattggtgttccaagtaatcactgagaagcaactcattgaaagttgacggtgcttcaacatagtaggtcgacatgtgggcattaaagtagctttggtgattatctgaaaagatgaattgaccagaatgcccgatttcatgaatcaaagtatagacatcactcaaacgacctgtccagctcatgaggacataagggtgcacgcgatatggatccgccgcataaccgccagaatccttgccactattggcagcaaagtccacccagcgctcttcttgatagcgagcaacttcttgacaatattctttccccaaaggttctaccgacttcatgaccaaatcataggcgtcgtcaatagtcacttgaggatttagggcgctatccaagtccaatttccaatctgcaaaggtcatcttttcaagaccatttactttggcaacatgcttgaggtatctctgagcaacgggcgcaaaatccttcatgatgaggtcaatctgacgatcaaacatagcacggtccacttcttgctcagccagaaggtaatcaaagacagagtcgtaacccttcatatctgccaatagtttttcagacttgacttgggctagataggctgctgcagccgtattttggtgcttacgaagaccttctgagaaggaacggaaagatttctcacgaacctcagcatcctcgtggttttggtagaaattctcataggtcacaaagctgtttttgtaggtcttgccattgacttcaaagtcggccatttcaaaatccccagctcgcatcttagtgtaaatgtcctgtggactgtagaaaacttcaccgagattggtcaaggccttctccacatcagcccctagatagtgggcttttttgatttttgcctgacgaatagccgccgtcaaatgaggtaattcacccaaacgatccaagacttcctcatcagcttccaccaaggcatcgtcaaagaaggtcaagactacgctagcatctgtttcaaattccatcccagcttgggcaatgttggcaaattcgtcattgctatagtctgtcgtctgaggcataaagccatagttaccaatatggctcatctgaatgtagatttgctccagttccgcaaaagccttttcaaaatcctcaaaagtatgaagattccccttgtaattacgactaaactggttgatgtcttcgcgagctttctcgattgcacgcaagaaatcctcacggtcttggtatagggctgttaaatcccaaagttccttctctggaaattctgaacggtgtttttgttccattttcttcctcttatttctctaattctaataaaacactaagggctgataaggcgtaaagcggtgctgtttctgctcgcaaaatacgaggaccaagacctgccaagactgctcccttagcttcaaaactttcgatttctgcaggtgacagaccaccttctggaccaaagataaagagcaatttggctcccttctcgagtccattaactgcttgtaaaagcgcagcggcttctccttcttttgccgactcttcataagccactacaatgcggtcaaattggtcaagttgggctagaaaatctcctttcttctcaaaaagcttgatacttgggaccaaattacgcttgctttgttctgctgctccaagggcaattttttctagtttttcaacctttttacccaatttcttgccatcccacttggcaactgaccagtctgctgggaaggcccagatttgactagctccgagttcggttactttttgagtgataaactccagcttgtctcccttgggaaatccagatgcgatggttacttgaacgggcagttccacattgtcatctagttcttggaccaactcaaactgacgagcttccacatccagcacatgcgccaaacgcttgactccatcatcaaagaccaaagtaacctcatcatcttctttcaagcgcattacctgaaacatatgcttgctggtttccttatcctcgatgatgactggcgaggtagcattaccttttacaaaatactgctgcatgctagcctccaatcacaccggaaatatccttggttttcttaaagacacaggcattccattccccttgaaccatgtgagtttcgaggaaaaatccagctgactcagccgacttgcgcaccatgtcccacttgtccttgataatcccactcatgatgaggtagccttcatccttgaccaatcgataagcatcatctgtcagatgaatgagaatatccgccaagatattagccacaatgacatctgcctcaatctcaacccccttaagcaaatcacctgcagctacatggatgttttccatgccagggttgagctcaatattttcctgagccacacgaaccgctacatcatctaggtcgtaggcgaaaatttccttagcacccagtagcgagctagcaatagagaggacgcctgatccagtccccacatctagcactgtttccccaccacgaagaacctgctccaaggcaaagaggctcatcttagtggttggatgggtccccgtaccaaaagccatgccaggatccagcttgataatcttttccccagcagtcgcctcatagtctgtccacgacggcacgatggtcaaatcatgagtgatgcgagcaggttcatagtatttcttccagttgtctgcccagtcttcctcagccaaggcagtcgtccccatcttgacttcacccaaatccataaaatctgtcaattctgctagacgagcctgcaaatctgactcaaccgttgctacatcaaccgtatcagggtaataggctgtcactacgatttcttcttgctgctcgacctcagggaaaatttcaccgaaacgattgacgttgcccacatagtccatactgtcttcaatcgcaacaccctgggcacccagctcaatcaagagattagagactaactcctctccctcacgcttaactgtaacttttaactcttgccatgtttccattattaagataccaagcccgtaaaacacaaagccaaaataggaaattctctgaagacgcttgtgtctaagagaagtttatctttttggcacagtgtttagggcgggttcagtttagaaatttaaccgaaccatcctttctaatcacttacttttaaataatcttttaatctctcttgcaactgaggtacagcttgactggagctaagaaattcctcgacattcatcagctgatggccctgtccttcatctccaaaggtaatattgtcaaattgttcttgtcttagctgaccaaccataaagacagagtaccgaccttcatagagcacacttggataaaccctactccaaagcagacaatcctcagtcagatgaatccccagttcttcataaacttcacgcgccgcacattcaaatgggctttcgtccccttcacggccaccacccggcaactcccacatattgggccaagggatattttccttatcatcacgcaagatgaccagtagcttatcaccacaaaataaggcaatcttgcaaccttggaaatcagtaagttctatttccatattagactccttcggttaattccttttccagctcagctaaccagttttgataatagcttttctcatcccgtaacatccgactgctattcattttctgtctagcaatcttcatagccttgtgagtttgaactacatctttctttaccttaaattgataccaagcttgaatgacctgcatatctgctgtttttagagataaaaaggatttgactcctcgaatacttgcatattcttccgccttcttattatctccttccatcagagcaacttgaagaaggtataattgagaactagttttagacattggattgtctgttttatctaacacagactgaaactgttgctttgcaagttctatattatcatccaatatgaataccaacccctgaagagtctgaacactttctgcaaaactccctctcacctcctcatcaacaggcatgataaagtcttttaaatcatattcttgaggagctagcaaggtctgggcagaatgcctcaacatcaggtaggcgtatttcgtattttcagggtgttgtagcaattcccaaatttttgctccatcggtgatgccgactggcaaaatgttatttaggaagaaagacaaattaagaaaaatccaagtccctgcaaaataccagcttcttgtcaaaaacccaaacactatcgccaataatatcaagctgagatgaaccatcaagcctcctgaaagcatcaggatgatgctttgatcgctttcatcctcttttaaaccaatgtattgagcaccaacatttttcataatggctgttctactaagacgaaacttgcatgactttttggtcaaaataaaatgtcctaatccaaaagccaccagccgatagcctgtcaagtagccacaaaaagcatgtcccagctcatgaagaataaagattaaatacatgcttagaagagcgaaggcataaccaaaagtaaagactaaaactgcggaataccccagctctgcaaatgcgatggttccacaagcaaaagccagcataataaagacaacagctagcacataaaccaaataaatcccaattttcttcataaaatctccaaccaactcctagtatctcggataaggataaaactctccctcttccaagccgacttttccttcttcaaagacttcttggttccattccatgacgaattcttctgcttctgggtcttccaaaaagtccatgagggcatctagtccaacctcggcagtatctttgaggaatagcgcaaaataagctaagaattcgcgggaaaatccttttttaggcaagtaagggatgacagtcaaatagtcttcctcattgactgttgatttagcaggattgtaaaaaagcactgcttcttcaaagaggatatcttctgatgaaacctctccgtcttcatccaccatctccacgcctgcagcattttgcgcttctaacaaaaaactcacttcaaccgcgtggttgcgcttatcccaactaatctcaaagtcaaaaggaaaattcttctccaactcttcctctaaaacatctaaaaatccgtatgttgccattttgtcctctttctatgcgactctttaatcgccccgattgctcggaaatatgctaaaatagatactaccatcttaccacatatacatcagaaaatctacgttagaaaggactgctatgccagacaatctcgcgcttcgcatgcgccctaaaaccatcgaccaggtcatcggtcaggaacatctggtcggacaaggaaaaatcatccgccgcatggtagaagccaaccgcctgtccctccatgattctctatggccctccggggaaatcggcaagaccagtattgcctctgccatcgcagggactactaagtatgcctttcgaactttcaatgcgacagttgatagtaaaaaacgactgcaagaaatttgcggaagaggctaaattctctggtggtctcgtcctattactagacgagattcatagactagataaaaccaaagcaagacttcctcttacctctcttggaaagtggtctggtcatcatgattggcgctacgactgaaaatcctttcttctctgtcactcctgccattcgtagccgtgttcaaatttttgagttggaacctctgtctaaccaagacgtcaaagaggccctgcagatagctctaagtaaccctgagcgtggttttgattttccagtagaactagatgaggatgcgctggatttcattgctacctctacaaacggagaccttcgctctgccttcaactcacttgacttggctgttctttctactcccgaaaatgacaagggcatccgccatatcactctagacatcatggaaaatagcctgcagcgaagctacatcactatggataaggatggagatggccactacgatgtcctctcagccctgcaaaagtctatccgtggctcagatgttgatgccagtcttcactatgctgcccgcttgattgaggctggtgatttgccaagtctcgctcgtcgtttgactgttatcgcttatgaagatatcggtttggccaatcctgaagcccagattcacaccgtgactgctctggatgctgcccagaagattggtttcccagaagcccgtattctcattgccaatgtcgtgattgatttggccctttctccgaaatccaactcagcttatgtggctatggataaggcacttgctgacctcaaaacatcagggcacttgcctattccgcgacacctgcgtgatgggcactacagtggaagcaaggaactggggaatgcccaagactatctctatccacacaactaccctggaaattgggtcaagcaagactatctaccagaaaaaattcgtaatcatcactatttccaagcagaagatactggtaaatatgaacgggctttggctcaaagaaaggaagctatcgaccgtttgcgaaaaatctgaaatccttttcaaaaaattgcactttcctcttgattttttttgtaaaaagtggtattatataaacatagaaacgctgtggtgtacgacttcacacttaagtgttgaccgactattttttgtattattagggaaacaaaagtcttctaacagcatgtaggccgtctcacacggaaacagcttcagttagagcgagttgcccacctgcttaattgcgcgggttcaatacaaaccgtgaagtttcggcaccaatacagcttttttctttgcctccttagctcagctggcagagcagcggactcttaatccgtgggtcacaggttcgatccctgtagggggcatctaaatacaacaggaaaaagccttgtaaatccaaggctttttttgcttgtctataactgatttaccccatcatttgtcccacattttaaatctatcttttctttttgaatcaaattacatctttacaaatagtgtaaagccagttacttttgctttgattccatacaatattttcatgtagagaagacaaattttatcttctctttttattttcaaaataataaaaactgattttcttttcataaatcagactgaaacttccaaattttccattttgtttattgacatttcctctaaaaaggtgtataatatttttattatcaaactatactatactatatagggggtattgaaatgaaattttctaatcgtttactgctattccttgcaggagttgtttttgtccttttaggacttttcctatttacaaacccagtagctaatcttgttgcttacagctggtggattgcatttggtttactggtttcttctatagcagctattttaggctatttctctgtaccaaaagagcttcgctcaccagctcatcttttccaagggattgttaatcttctcttagctctttacctcgttgcctatggctttgtgacgctgccagttgtcattccaactattttaggaatttggttaattgtagaagccattatagttttctttaaaggcaatcgtctgggattgattttccctattattggcaaccatatcatgtggatagcgttgcttgcatttttactaggtctagtgattttgttcaatccagtagctacaagtgtctttgtcgtttatgtcgttgcctttgcatttttaattgttggtttcacctatatccttgatgcctttcgtaaataatctagctgccattttgggcatattaaaatagctgggaagttacattctcagctttttctgttgcctccttagctcagttggtagagcagtagactcttaagctatggggcgcaggttcgagccctgcagggggcacatctaaatcaacagaaataagccttgaaaccaaggctttttttaacgtctaatagctttttgtagaaaagtatttaaaaataaaagagaagagaatctctcactctcttctcagtatatcttattaaatttagtttttcttaatctagctgattttcctttgcaacgacaaattccttaaccaatcgatagataacagcaaatatcggtgtaaagaatatcatcccaagtaagccaaagagattgcctccaatactagcagccgcaagcgtgaaaatagctggcaaaccaatagattgacctacaactctaggataaataaggtttccttcaatcagctgtataacttgatatagaagaagagaaagtaaggcttgagtaggactcactgtgaagataaaaatcgctcccacaacacaagcaatcataggccctacataaggaatgaacgatagcactcctgcaaatatacctgtcattaccccataaggtagtccaaacaggctgtagccaaccgctatcataactcctatgatgactgcttcaatcagctgactcatcaaaaattggtcataagtctctagtgctacttgtccaatgtaagttaactttgtcaccactttctctggaaatataacttttagaagtctactcgtcatcgctgccagatgttccttactggataaaaataaaaaggtaaatactataatcagaaaggcattcattatactttgaaaaaatatttcctatattactagtcagaccggataagaaggttatcaaagcttgactaatagagctagactgtccctgaattcctgatacgatagttgacagcatgtctttggttacaaattccgagctgtctagcaatttcccaagttgagtcaggactgttgaaaggactgctcccagctgactaatagtctgagcaagggttggaagcaccaaaaccaaaagacagatcacgattaagataagagataggaaaacaagcaccatagcaatcggacggcgcaaccctgcctttaccttcattttaactaggaattcttcaatttttttcatgggaacattgagcacaaaagcaatgacagcaccataaatcaaggtagaagttacttcaaagagagatactgcccctgatataaagcttgatgcattcagaattacaagagtaaccagccctataaaaagtattaatggggtgtatttttttactaaattcataaattctccttaataaacatgtttagatacgactatactatttggtttttcaaactctcggtcaaggtaagcttggtaagttcctggtgcgataaatcctttgggtgagaggatatcggtgccagcctgaccgactatggtatcagccaagagcacacagtttgtagataagacaaagtaggatttaaacttagatttgataaatttataaagttccccatctgtctcatgtctgattttataagcgtaggtgtagtcttccttaccatcacctgtcatgattttatctgcacttggctcccatggaatcgtcagttgtttcaattcagccaactttttctgaactgctttttccatttcaggcgtcaaatctatcccataaccaaaaagcgttttttgactctcacgtttacataggtcaatgtacttgtcacgatcacagaaatataagacaccatctcctaccatgccaaataaggtctcagaagacggatcatagttgccataagaaataacacggccttgatagcagatatccacatgaccaattgccgaaaacagagaggtctcagctgtatgaacaaaaatttcaagctccgctgtcttaccagacttcaccattccaagatggatatcctctctctcatcagcattttcctgcatgaatttgttgatttttgctaaagttcttgcagggatgagagcggctaggacaataggtaagctaattctaatacgacgtttgagatggtttttcccaatttccccttcaaataagaaaccgtcacggatattggacagaccataaaggaaaaaataagcccctaatacaaagagttgaaagacagaatttcctgtagaggacaaaagactagtcccaccaagaaaaactagtacgagtccatctagtaagagacgaaaacgaggtcgaattttgtttttgcggtagagaacataggtgacaaggttaatactagcatgaaaaatctgataaactccaatcacaagagccaaaatataaatcggcacatccgtcgcaagattggagccaagcaaatatcccagcactaacaatttaaccagtgcaactcccaaggtgtccgttgactgactttttttgaaaatacgtaatactaaatctaagaccgttgctatccaagctaaaaacagaaccagtcgaataacctttactggcaaccaagtccccgtgaccatcaagatgagacctagcagaacaaacaagaacccctgagcaagtaatttcttacctgtcagacctaaagatagaattttcgccatataaaaacctttcaacaataaaaattaaacactccgattaaactgactagtaaatagccaacactacaaacagcctgtgccagcaacatatggtgactagaaatgactgtagtaatgtcaccatcttgtcttatgcacttctaaaatttgttatattgattagaagccagagcttataaaaactagctaaactcgagagatagacacaattgcgacgaaaaaatgtataaccaattcaacttgttaaggtaagaaagcattatttccaatctattaattattcatctattacctattatgacacaatattccctatagttcaactttttacttgtttttatattacacggactaaaaagttttcaacagttgattgcatttgttttaataagttttaacctttcttggttagataaaaaaagaaccatacagtttagaatctgtatggtttttgccccacttttgtcccatttttaaatcatgacattgaaaatacctaaaatcacttatatttcaatatttttaattgctctcaatatgaaagtcctttccaaatccctgtagggggcatctaaatcaacaggaaaaagccttgatttacaaggcttttttgcttgtctataactgatttgccccacttttgtcccatttttaaatcatgacattgaaaatacctaaaatcacttatatttcaatatttttaattgctctcaatatgaaagtcctttccaaatccctgtagggggcatctaaatacaacaggaaaaagccttgatttacaaggcttttttgtgtatctgttctacttttggtcaactaatggatatcaacggtataattttatgaacacccttcccagacagctctaatctgattgcactcaaaattttttaaaatttaaaacaaaagacttgcttttcttttaatttatgttataattgttcttgtatctgatacaagtttattaagagagggattcatatggatacaaaattctcagttgctttgcatatcttaacaatgattagtgaaagcaaggaaaccttaagttctcaagcactagctattagtgttgggactaacgctagttacattcgaaaagtgattgccttattgaaaaatgcagatttgattcattcccagcaaggaaaaacaggttatcaactcagtaagtctccaaagaaaatgactttactagagatctactatgctactcaagaaatcaatcacattagtttattccctgttcatcaaaatagtaatcccgattgtcccgttggaaaacatatccaaggagcagtttcaccgcttttcgctagtgccgaatctcaattagagaaggaattagcaaatcaaactttagaagatgtcattgacaatctatataaacaagccaaacaagtccgaaactgatttgatagcaagtcaagtcagtttttattggaaacaacatatacttgtatcagatacaggtatataaaatcatattaaaaagaaaagagaaaacacatgaaagtcgcacaacacactacttataacaaaaacaatatcacactgaacatcacagaagttgctaaaccaagcattacagacaaacaagtcttggtaaaagtaaccgcagccggggttaatcctctcgataacatgatctctcgtggcgaagtcaagatgattgttccttacaaacttcctcaaactgcaggtaacgaagtggttggaatcgttgaaagcattggcaagaaagttaacaactttcaggtaggagatcgtgtctttggccgtctgccacttgatcatatcggtgcctttgcagaatacgtagctgtcgatagccaagccttagccaaggttccagactatctatcagacgaggaggctgcttctgttcctcttactgccttgaccattatacaggctcttgaactcatgggcgctcaagctgggaaaacgatctttatttctggtgggactggtggtgtcggtggaatggccattccaattgccaaggccaaaggtttgaaggtcatcaccaatggagctggagatagtgctgagcgtgttctgaaactaggagcagatagatttatcgattacaaaacagaggattatacaaaaactgttagccaggttgattatgtcctcgatacacttggtggggctgaaactgaaaaacaaatgtctatcatgaaaaaaggtggtcatcttgtttcccttcgtgccatgccaaacggtgcctttgccaaacgcatgaatctaccaaaatggaaacagatgattcttggcttagcaggtcgcaaatttgataagatggcggaaaaatatggcgtccactatcattttatctttgtagaaagcaatggcgctcaattacaagaggtagctgacctctttagtaaattagaaatcaaaccctctatcgatacagtttatccatttgaagaggtaaatagcgcattagacaaggtcgctaatggtcgctcacgtggaaaaacagtcctcagctttaagaaataaaaaggaaaacacaatgtcatatcttactacaaaaaatcaatacatcacagtcgacggaaacaaaatcgcttatcgcgaacttagtaaaggcaaatcaaaactacctcttctgatgctggtccatttggcagcaactctcgataactgggaccctaaactcttggacttgattgctgaaaagcaccatgtcattgtagtcgatcttcctggtgttggagctagtcagggcaaagttgcttcgacgattcctggaatggctaagcagacaattgactttgtaaaagcgcttggttacgataaaatcaatcttctcggtctttctatgggaggtatgattgcccaagaaatcatccgaatcaagcctactctagtcaatcgtttaatcttggctggaacaggacctcgaggcggaaaagaggtcgataaggtcacaggaaaaacctttaactatatgtttaaagcgggactcgagcgcaccgatcctaaacgctatatcttctataatcatgataaacaagggaaaattgaagctttgaaagtcctaggacgaatggggatgagaacaaaggaatttgcggataaagacatgaacctatcaggattcctaactcaactcaaagccattaaacgttgggggaaagattctcaagacgacctaaaatttatcacccaagcaaccttaatcgtcaacggggataaggatatgcaggttccaacggaaaattcttacgatatgcatgagaaaataaaagatagcaagctgattatctatccaaatgctggtcacggttcgatcttccaatatgcagacgaattttcaacagaactaatagctttcttagaggactaatatggtcaaaacaattctgattacaggtgctactgacggtatcggtaaacatttagcaaagaaattggccagccaaggccatcatatcatcctccatggtcgaaatcctcagaaacttgagctggcacttcaagaggttcgcgcaatttccttgagagaccgagtttctagctacttggcagatttttctaaattagatgatatttatcgatttgtagaggaaattaagcgagactttcaaagtatcgatgtcttgtttaacaacgcaggcctttatgcagggaaagaacgaaaagcgagtgctgaaaatgtcgagttgacttttatgttatccgttctcgttccttatattttaacaactgagctaagtcccttgttagaaaaagcggctaacggccgtgtcattaacacttcatcctatatgcatcattttgcaaaggtcaaggatttggacttcggatttgagaacaactataatccaggattggcctataataattctaaattatataccatttggatgacacgctatcttgccagagagttctttttaagaggttcaaatatcactattaatgcctaccatcctggcttgatttcaactaacttagggaatgattccagtgatgaaaagacgaaaaagtctctcttcggacgcttgatgaagtcattttccaaaaatctagacgagggaattgaaacaggctactatcttacattgtcagaagaagtcactggtttgactggctactattttgatgagaaaaaagtgaaatctgtatctgaaaaaggctatacttttgagaaagctcgagatttaatcaattactgtaatgataaaattgagttgtttaaacagaaatctgctctgcttaattagaaaaaaaaattctctttccattttgctagaaagagaactttttctttaggagaaataacttatactcaatgaaaatcaaagagcaaactaggaagctagtcgcaagctgtacttgagtacggtgaggcgacgctgacgtggtttgaatttgattttcgaagagtattaatttttaatcgattcgtgatagctccgctggcactgttaagtaataggttgccgtcaagcttgcttcgccttgattgacaaaaatctcgatggaatttttatctagaataacttccaattctttagcttcaagatctacataccgtcgactagtgtcctgttcttcttcacctagaattttttgaacaagatggctacgatcaatgtaaacttgctgcgcattactgtcataaccaaattcaagataatctgtatcatttcctaagtggtaatgacaatctttatctatttggatttgatattggccttttttaacagggaattgtcttagtttgccatcttccaatcttagaattctaggtaaagtcatggcacatgcccatttgtgttcttggtcatgggttggaagggtacgcccccatgtctgcatccaagcaatcaggatacgacgattttgatcgtccaacaatgtttgaggcgcatagaagtcttgcccatgatcaatttcttgaactgattctgggataaaacgtttttctccccaatctaccttacccgtgaacaaaaccgatgagttgatgttatgatatgagtctccttcacgctgataacgcatgggtgacataataaggcaatctttcccatctaactcaaagtaatctgggcattcccacataaagccttggtgttctaccccttttaaaaagatggattcgaaccgccattctactaggttatcggaccctagtagaacgatacagcccacattatccttgtgtttggcagctactacggagtaatagcgtccatctttttcaaagagttttggatcacggaaatcagctgcaattaactcatctggcaagtctgctccagttgaaactggattttgttcaatcttttcaaagtgaatcccgtcgtctgaaaatgccatattttgcacttgacggacaccggtttcttcttcgatgtgaccagtatacatgagccagagacgatcgtctttgacgatagctgatcctgagaagcaaccattgcggtcgtagtcttggtcaggagcaagtgccacaggcaagtgctcccaagtcaccaagtccttacttttagcatgaccccagtgcataggcccccaaacactatcataaggatagaattgataaaagagatggtattctccacgaaaatagacaaatccatttggatcattgatccaaccaatctcagctgaaaaatgttctttaggcttatattgagtatttacgagatgtttattttctgctataaaacgattggctttttctactgtaaatgttttatttatcataagtatatcctattttattccagttccggaaccacccagaccttgaacaatatatttctgagcgactacatagaccaaaatcaacggaatcgttgaaatagttaatacagccattacctgattgatataaactggttgagttgtattaatagttgtaattgcaacctgcattgaaaatttagaagaatctgtcaaaaccatcaatggccaaatataatcattccagcttgaaataaatgataaaacaccaactgtagcaactgcaggtttagacattggaagcataattctaaagaaaattctaacgatacttgctccgtccatctttgcagactcaagaatctcttctggaattgcaataaagaaattcctaaataagtaaatattaaatacactcgccaatcctggaataataactgcaagacgattattgaccaaacctaaggaattgataatggtaaattgtggaattaacacagtttctactggaataataagtaaagcaagtaagaaaccaaatagaattttcttacctgaaaaatttacttttgcaaaagcgaaaccggccagtgcattgacaataatagaaccaatagcaaacgttccagcataaaaaatgctgttccctagatatgtaaaaatactaaagcgctcaaatacttcctgataaggtttaaaccaatcagcgggatttaaacttggtaagaaggcttgccaactagtcaaatttttataaacatccgcttctggcttcatagctgaaactaccatccaaaccataggaaaaaggaagagtcctgccaataaagttaacagaatatattctaagattgttgttggtttaaatcgtttcatcttagtcatcctccttcagaactcgacgttgtactaagctaatcataccaattaacgttgtaaatactaaagcgattgagctagaatatcctacaagacgatcagtaaaaccttgttgataaatatagtacaccatagtaattgttgagtttaatggcccaccttgcgtcataaccattggttgtacaatcagcttaaaagcagaaattaaagttgttaacaatacaaacagtgctgttggttttagtaggggcatcgtgatataacgaaactgagcccattttgagaatccatccaattcagcagcttcatatacatcttgtggaatattctgcattcctcctaaaaataaaagcatctgataacctgcaccctgccaagcagaaacaaaaacaattgcatacatagcttgtttaggactagtcaagaaaggttgagaagcaatacctaccttatttaaaatagcatttaataagccactatttggatttaaaagataaagccaaagaatagaaataactaccaaggacatgacaactggagcaaaaaaagccactttaaaaaacatattccctttgcgctttttattaacaatcaaagccattcctaaggctgctcccaattgaactggaataatccaaacaacaaatttcaacgtattcaagaagctctttaagaaaatcggatcctttattaatcgaataaaattttcaagtccaacaaattttctttcatctggtgtcaacaaataataatctgtaaaagcgtaataaatgaccattccaactggaattactaaaaagatacctaataaaattaaagctggagctaaaaaactataacctagtatgttatcctttattttttcacgtctttttgtatccacaacagtttctttactcatatccatctcctttaatcatatatatcaaactaggctattaacaagaaaggggaaggtagttccaaatattttccttcctccttcctttttacagattatttgagtgactgatcaatagcagtttgcatttcttttgtacgagtatccaagactttttgcacatttggattttcttcataatagctaatatcttgcattgcttgttgaaaagctcgagaaacctgaggatatgctacgacaactgggcgagcatgagctgtttttgaattttgttccatcaagaaacgcattggttcggtcactttatctttgatattttcaattgtagatttacgaatcggaaggaccgaattccccaagctaataatttcacttgattctgtatttgtagcaaatttaacaaattcagatgctgcctcttttttatcagattttgtcgtaacagctaattgccaactacctgaaggggatactaattttttcgtcttactagatactgggtaaggaaggataccaaaatcaatatctttgtagtttgtattcatgtcagcaatcgtccaagaaccactcaaaagcattggatactctcctgtttcaaaacctttttcgactggactaacagttgtgtaaccttcttttacaagattttgaatgaattgaactgcttctacactctcttttgagttgaagtatccttctgcctttgttccatcttcgtttacgacagaaccattatttgaccaaatcaacggcatataagcatatggtaacatttcatcgtttgaattaatacgaaaatcaattgccggtttgttataatgatctttcaattttttagcaatcgtattaaattcatcccatgtccatggcttttctagcgttggaagctctgattccgcaattccggcctctttgaacatttttttgttgtaataaacaccaacattcgattcagaaaatccaaatgcatagaatttgccatcataagttccttgttgtttaatactgtccaaaacatcatccatattattatcttttagataatcatctagcggagtaatcactttagattttgcataagctgccgtatttggtccatcaagggtaataacatctggaagactattagtcgtgatagcagcattaaccttgtcttcatatcctccaccactaccactacgaggaatatactcagttacaaccttgtacttactttttcctgattgattaaagttatcaacaactttttgccaagcttttccttcattggtttcgtcagagaattgtacccagactttaatatcatttgaagaactcgcttgttttgagttagttcctccactacaacctgcaagtatagctaacgatagccccgcaacaacagataacattgtacctttacgcatatttttcctcctttttgaaacgtttcatttatagtttatattataacagcgctttcattttttgtcaagtgctgtttaaattttttttgttgttttatctccccaaaaatatgtgggaattacgattcgtttttctagaatctcttctcgcttaatcattttcagtatcattgcaacagattcttttgccatcataccaatatcttgaactattgtagacactagataagattgatcgacagaagtttttaaaccatcaaacccaattatctggtaatcatcaggtgctattttccccagttctttcataacactaataactctcagagccatcatatcatttattgtaaatataccatcaatttctttatgagattgcaaaaaaattcttatctgatcttcaggatttattaaaggttctttcatttcaaaattatagacatctactcctaattccttagctttttctctgaatcctttacttctgagtatagtctcattctcatacatattaattgaaccaataaaagcaaggtgcttattatcccttctaaccagttcctctgctgcagtttgtcctcctttgtaatttgctgaagtaacatagcatacattttccgaaaaatgtctatctatacttacaaacggtaaatcagataaaatatatttgtcaatatcagaatatgtaataccaataattccatccactttattttgtttcaacatttcgatatattcgatttcattttgtgaatcgctatcagcgttacaaataaataatttataattatattttaataactctttctcaacatgataggcaaactccgagaaaaatggatgccatatgctcggaataatcaaagcgatagtttctgttctattctttttcatacctcgagcataattatcagggatatagtccaatgtttttatagccctttgaactttccttaaagttacttctttaatacctttttctttattaattacacgtgaaacagttccaacactaactcctgcttctaaagcaacatctttcatggtaattgattttctttgttctaccatcttatcacctcctttcaatatatagtatcatgcaaacgctttttaagcaactatttctcaatcatttttgtccagattctttttcctatcatgaataaaatcactccaattatcttttgaaaatacttcaattttcatgtgtagacatctacataaaacaggaaaaaccttggaatcaaggctttttcgtatcttctacaaaaaaagcaagagatctagagggctatgaatctagatgtacattttgcttaaatgattgaatgtcttttcttaacaaaaacaccccaaaaattagattttttctgtctaacttttgaggtacagttcaaacgcgaaatagcgtttttttgttatttttggttactcatctaatcgaataaacatcatggcatttaacaaagatatgagtgataccttgtttatattatttgaatatatcagtctcttattctcaatcggaggaataataaaattagaaatgatgatatcataaggcgattcttctaaagattcctttgataattctaattcagtccaaacttcaagttcaaaattgttgctacaataataagaaagtgtctctgcaacggattttgcatgatactgatcaaaattactcataaccaggagcagctttaacattctatgagttgacaaattcattggaaagcttgtttccttatataccaattctaacaattgagataggggctctgatgaaaaattttcaaatagccattctaggaaataatatttttctgaaaaatattgtgcaaaaaagtaacgaatgtctctctcatttccaatgatttgaacaggggtcagactgatttcaaattgaaattgccttttaatcactttattgatttggctaataatacgatagagcgaagatgaactgatataaaattctttacaaatactctcagcttgacaaccttcattaaagaatataaattctaaaatcgaaaaatgagttgaatccttaaagaaatgatggtaaaccatttcaatatcactatcatcggtattaataatgcgtataccattagtcgaagaatgaaaaatcaagtcaggaaaagcagatttaacatgggatagatcatctttgactacacgttctgtacaatttaataactctgctagttcagaacgatgaaactaacgtttatgttcaaataataattctaattgcctatgacttttttagataataaatctctcatgaatgtctttctctttttataaattatcggatttcacctcttgcaattataccacaaagaataggtatagcatgatataacgacttttactaaaatcctttatttcgtataataacactacggaggcaatatataaacaattttcttattttaccgtctattgagggcgtgaatacaggatcaaattcaagtcgaaagattatatttttatttttaaaaatttatataatagcaacaatcaaagaatttgatttttttatattaaaattatataataaccaaaataattgatttttttatattaaaattatataatagcgataatcaaagtaattgatttattttttaatattaaaatagaaaaggagggtaagcaatattgtggtcaatcattgctggaggtcttattggacttgtagcaggtagaatcactaaaaaaggtagttctatgggaatcgtcgcaaatgtattcgctggtttagtcgggtcatctgtaggacaatcccttttaggtagttgggcccatccatcgctggaatggctttgatcccatctattgcaggagcagcaattgttgttactgtagtatcattctttacaggtaaaaaataattacttgtagaataaactatttttaaatagattagacgggtaaaaatagtttaatgttaaatcgaaaggattgtatatgtcaaaaacaaagaaaatatttttaattattttctgtattttaatcttgacaattttccttcctgttttgatagattatcatcaagttagtgatctaggcattcagctatttagctggagacagaatcatttcgttgaattctatctctctagatatatattctgggggatagtggctctatcaactttagttttgttatcgatattagttgtgttgttttatcctaaacgttatttggaaattcaacttgaaactaaaaacgatacattaaaattaaagaattctgcaatcgaaggttttgttagaagtttggtaagtgatcatggattgatcaagaacccaactgttcatgtaaatttacgaaaaaataaatgtttcgttcatgtagaaggtaaaattcttccttcggacaacatcgctgacagatgccaactaattcaaaatgaaataactaatggattgaagcagttttttggtattgagcgtcaggttaaactagaagttctagtaaaagactaccagcctaaaccaaaacctcaaaacaaaaagactgttagtcgtgtgaagtaaggaagtaaaaaatggaatggcttaaacaatatcgatatccaattatcactggtctcataggcgtatttctcgcttgtttgattatctcctttggcttcttcaaaacaatatttgtattgattttaggagcactgggagttgcagctgggttatatatcgaaaaaaactatatagataaataaaaaataaaaattactaatttaattaaaggagtttcatatgtcaaacgaaaaaaacacaaacactaacgtagaaaagaaagatgctactgctgtagctcacgaaatcaaaggggaacttacttacgaagataaagttatccaaaaaatcattggtctgtcactagaaaacgtttcaggtcttttgggaatcgacggtggtttcttctcaaatcttaaagaaaaaatcgttaacagcgatgacgtaacaagtggtgttaacgtagaagttggtaaaacacaagttgcagttgacttaaacattattgctgagtaccaaaaaaatgttccagctttatattcagaaatcagagaaatcgtatcttcagaagttgctaaaatgactgacttggaagttgttgaaatcaacgtaaacgttgtcgacatcaaaacaaaagaacaacatgaagcagactcagtaagccttcaagatcgcgtatctgacgttgctgaatcaacaggagaattcgcttcagaacaattcgaaaaagctaaatctggtcttggatctggtttctcaactgttcaagaaaaagttagcgaaggtgtagaagctgttaaaggtgcagcaactggtgtagtatctcacgaaaaaactcgtgtaaactaagataaaataaatataacaggaaaaattatcatgtcagtagaagaaaaattaaatcaagctaaaggttctattaaagaaggtgttggaaaagccatcggtgatgaaaaaatggaaaaagaaggaacagctgaaaaagttgtttctaaagtaaaagaagttgctgaagatgccaaagacgctgtagaaggtgctatcgaaggtgttaaaaacatgttgagtggcgacaataaataaggctaaaagttactttatctttttagtaacattagtcaaaagagtctgagtcaagatgattctcagaaaacaaaaagctagagatttccaattgcggaactctagctttttaattttgcctctttctcttattatatttcagcaggttgttgaccatgagtacgaatcccatgtcaattctcacttggcgcttacctttcagatgacatctcttataaccaaacaaacctttatctgcccaaagacagatttcatatcaatcttacgtttagcgaaaatttatctacccttggaagataaaagtgcctgatattctttaatttttaaacactggtaacgttcattcatatacagtcccttttgaggggctgattcaggttcatcatcgcagtcaagattgatttcaaggctgtttgcttctatctcccctttttcatgatgtattttcgtacaggtgcttcaaccacttgaacgatttcaaatccttctttttgataaaggtgctgggctgcttgatttgcttcgaggacatttaaagaaatactacctatgtctccattttcaaagaccaaactaacaaatttccttaaagcctgcctacctaagccttgtccctgtttctggggattgataaaaaatctcccgatatgaagattgctgtcttcttgcctgattttctggataagccccacaaactcttgtccttcaaagattgaaaagattccttccaaatcttgcaaaacttgaatggtcaagggaaaaggaatccttggtcccatccattgttcttgaaaaactttgccaagggagttggaccattggcatacgagctgagcattttctgtgctcaccttttcttcaaaacgaattgtcatctttgcctccccatcttatctatgtttctccattatactacttctcctattttttacgaatagataagtatgattaatatttatttttttcttgtcgggagcattctcgcttcctttcttggtttggttattgaccgtttcccagagcaatccattatccaacctgctagtcactgcgattcctgtcatactcccttgcgtcccttagatttgattccgattctctcgcaggtcttcaatcgctttcgctgtcgctactgcaaggttcgctatcctgtctggtatgccttctttgaactaggcttaggactcctctttctagcttggtctttgggctggctttccttgggtcaagtcatcctgataactgccggtttgaccttgggcatctacgactttcgccatcaggaatatcccttactagtctggatgacttttcatataatcctcatggctttctgtggttggagtctgattatgctcttctttcttgttctaggaataatagcccattttatcgatatccgtatgggagcaggggattttctctttttagcttcttgttctatcgtctttagcgtaacggagttactgatcttgattcaatttgcttctgcgatgggaattctagcctttctcctgcaaaagaaaaaggaaagacttcctttcgtacctttcctcttacttgctgcttgtgtgattatttttggtaagctactgcttgtctgataaagtcctgaattggctctccttgatgaagagcttttacgatttttgaaccgacgataacgccatctgacaccgcattaaagcgttctacatcggcttgactagatacgccaaaacctgtcaaaactgggatatcggccacttgataaagttgtgccaagtgcttgtccaaatctgcacggtaattgcctgatttccctgtcaccccgttgatagcaacggcatagacaaatccttctgcccctttaatcaactctttctggcgctcaattcctgtcgtcaaactaactaggggaatcaaagcgatgtctgtatctgccaaataaggctccacaaaattggcatgctcatgaggaaggtctggaatgatcaagcccttaaccgctgtatctgccaaatctttgacaaagttctccacaccgtactgaaagagggggttgaagtaggtcatgatgacaagtggaacctctgtttcaatggttttcaatgtttcaaccaaagcctgggtagaggtcccgtgggctaaactgcgcaagccagcttcttcgataacaggtccatctgcaacagggtctgaaaagggaataccaacttcaatagccgaaacacccaaatcttctaaaaagtgaattgtttctccgagtccatccaaacctttctcatggtctccagccatgatatagggaacgaaaattccttttccagctgcttttatagcgtttaatttttctgttagtgtcttaggcatgagcttctcccttctttgctgcatctgcttccaagaggtctttgacttgaaccacatccttgtccccacgacctgatagacagacaatcatggacttgtctggaccgagttctttggccaatttcaccgcaaaagcaatagcgtggctagattccaaggctgggataatcccttccacacgagacaagagttggaatccttccaaggcttcttcgtctgtcacagggacatagctggcacgtttgatatcgtggtagtgagaatgttctggaccgataccaggatagtccaaacctgctgagatagagaaggcttcaagaatttgaccatgggcatcttggagcacatccatgagagaaccgtgaagaacaccaggacgacccttggtcaaggtagctgcatggtgctccgtatccacaccaagtccagctgcttcagccccatacatggctactgactcatcttctacaaatggatggaagagcccgatagcattcgacccaccaccaacacaggctactagagcatctggtaaatcttgacctgtcaagtcacggtactgttgtttggcttccctaccgatgacactttggaagtcacgaacaatttctgggaagggatgaggccccaaggcagaaccaaggatatagtgggtgtcgtcgatatttgccacccatgaacgaagagctgcattgaccgcatccttgagcacgcgcgaaccgtctgtcacagcctcgaccttggctcccaaaagctccatacggaagacattaagggcttggcgtttgacatcctcctcacccatgtagatggtacattccatattaaagagggccgcagctgttgcagttgccacaccgtgctgaccagcacctgtttcagcgataattttctttttacccatgcgtttggcaagcaaaacttgtcctaaggcattgttaatcttgtgggcccctgtatggttgaggtcttcacgtttaagataaatcttggctccgccaatatgctgggtcaagttttttgcgtagtaaagaggagtttcacgtcctacatactggcgcaaaagttggtttaattcctcttggaaacttgggtctgcctgactttcacggtaagctttctccaactccaaaactgctgtcatcaatgtttctgggacgaaacgtccaccgaattttccgtaaaatccatctttatttggttcttgatatgccattctttaccctctttataaatcttctaatcttttcatgatctttttgtccatctgtctccactccgctcgatacatctactgcatagggagtaaagtgttgaattgcttttactacattgtcttcattaagcccacctgcgataaagaaaggctgagttagtcctgtcgtatccagttgcccccaatcaaaggtctggccactcccagccacaggggcatcaaagaggagatagtctgcctgagaattgggcacatgaccctctccatccacctgcacagcctgaatactggcacaaggcaaattctcaaataaatcatctgccacctgaccgtgaacttgaaccaagtccaagccaacgttgtcaatcgtttctagcagttctgcccgacttggtgaaacaaacacaccaacctttttgacatctgcaggaataagctttgccagctcggcagcctgatccaaagtcacctgtcttttactaggtgcaaagacaaaaccgatgtagtcgactcctgctgatacggctgtttccaccgcttctttggtcgataatccgcaaattttaacctttgtcaatctgcaactccttgattctctgggctacatcttctgcctgcatgagagctgtccctactaaaattccgttaaagtatggcgctactcgttccgcatcctgccctgtgaaaatagcagattcagaaatgtacaagcaatcatctttgaaatgtttagccaaatctacactggtctgcaagtcaacttcaaaggtagtcaagttgcggttattaaccccaataatctcagcaccaagcctgtgggccacttctagttcagctagattgtgagtctccaccaagacttccagaccaagctctgtcgcgtagtcatagagttccttgacacgttcttctgacaaggcagcgacaatgagtaagataactgtcgcaccagcattgcgagcacggatgatttgcttttcatcgatgataaagtccttgttgagcgtcggaatctctacctgactggaaatctcccgcagataatccaaatgccctttaaagaaaacctcatctgtcagaacagaaatcatcactgcgccgttttcttcataagtctgagcctgttgcacaatatccacatctagattgatatctcccagactagggctagccttcttgacttctgcgattacctgtaaacggtcttgatgttgttttagatagtcagctaaacgataggtctggcgcaggggctggatttcctccagctccagctccatctgctcgacctcacgcgccttctgctccaaaattcgtgctaaaaattcctgactcatttttggtactcctgtaacagtctgagtttttcaagggccttgccactagcaatgacttcgcgggccaaggcaactccatccttgatgctagctaccttgccattagcatagaaaccaagaccagcattcaagactgtagtttccaagaatggacttggttcgttcttgagaacactgagcaaaatttctgcattttcctgagcattccctccacgaatatcttcgatagcgtagccttccattcccaaatcctctggagtaaagcttgacaaggtgatttcgccattttcaagaagtgcgatgttagttgttccgttcaagccagcttcatctagcccttctggcccagcaaccacaatggcacgtttgcgacccatatttttcaaaacctgagctgtactttctagaagttctggacgactaattccaagaagctgtgtttccaaggccattgggtgaatcaggggaccagtcaagttcataatcgttggaattcctagttccaaacgagctggcatgatgtatttcatagctgggtgcatatttttagcaaagagaaagacgatgccagttttgtcaaagaccttacctagttcagctggtttgaggtcaaggttaatactcaaagcttctaggacatctgcggaacctgatttagaagaaatcgagcggttaccgtgttttgccatatgaacaccaccaccagccaagacaaaggctgcagttgtagaaatattaaaactgaaagacttgtccccacctgtaccacagttgtccatggcatcatgaatttcagttggaatatgttgggcatgccctctcatgacttgggcaatggctgtgcgttcttcaggtgtttcccccttcatcttaagagccaaaaggagagaagcaatctgtgcctctgttacacgcccagttacgatacgctcaatgacatccgtcatttccacacctgataaattttcaaattttgctagtttttcaataatctctttcatcctagtttcctcactttacaaccttctcgataaaattccgaatagaagacaagccatctggcgttccgatactttctggatggtactggaagccataaatcggtaggtttttgtgttgaatgcccataatagcttggtcatcagtcgaacgagctgtcacttcaaagtcttctggcatttcttcaatcaaaatactgtggtaacgcatgaccgcacggccatcctcgatgccttgatacaaaacagatggcgcttcaaagctgatattgctctgtttcccatgcatgacttttggtgacaagcctaacttcccaccaaagacttctgcgatagcttggtgacccaaacaaattcctagaatcggcttcttgccggcaaagtcacgaatcatatcttccatctttccagcatcaactggccaaccaggaccgggagaaaagaccagaccatctgctttttcagcttcttcatacagcttgggatcatcatttctcaagacctgtacttctgcgaaattcccaatatattgggccaagttataagtaaaagaatcatagttgtcaattaataaaatcatggtcttagttctccaattctagtcatagatttagccttgttaatggtttcttggtattcgttttgggcgatggagtcgtagacgatccctgccccagcctgcacataggctgtttgatttttgagaatcatggttcggatggcgatagcgaaatccatatcacccgtcgcagacaagtagccgattgctcctgcgtatacgccacgtttttctgtttccaattcatagatgcgtctcatggcccgaatctttggtgctcctgaaactgttccagctggaagtgttgatttcaaggcatccatagcagtgagttctggaagcaaacgccccttgaccacgctggtcaaatgcatgacatagcggaaaagctccacttccatatacttggtaacttggacactggctgtttcagatatgcgaccaatatcattacgacccaagtctactaacatccgatgttctgctgtttccttctcatccgaaagcaggtctgtcgccaaagccttgtcttcttcatccgtagcgcctcttggtcgtgtccctgcaatcggattggttgtcacgatgccatttttgacggaaaccaaactttctggactggcaccgataatctgataatccccaaaatcatagaaataaaggtaattggatggattggtcacgcggagatttctgtagaagtcaaatggatttccagtaacttctgctgagaaacgctgactgagtacgcattggaacatatcaccatttcgaatcaagtcacgagctgtttccaccatttcctcaaacttctgaggagcgatatgcggtttgaagtctaacggagatagatccaagtcttcaaattcatttggagcaggaatgcgtaattcctcaagcacttggttcaaggcttcttccaagttttcttgactacgctcactatagagagcatcctcgatgacatggattttttccttcttgtggtcaaagacaatgtaactctcatagacgaagaaatgcatatctggcgttccaatagtatcttcaggaatttgaccaatttcttcataaagcgaaatcatatcgtaaccaacaaaaccaattgccccaccaccaaaaggtaggtctgaatggtgctggctcttatgagtcacttcataaaggaaatccaagggatcctgatcaatcactttcccattttgataaagaactccatttgcaaacttaatctcaaaaactggattataagctaagatagaaaaacgagctgtttccttgtctctcggaatactttctaaaataaccttgtgttgtccctttagacgcatataagccaagattggtgataagacatctccatgaatgattcgttccattgtaatttccctttcagttccttatttttaattttttatctttttctatttcccttaaatagtgcggacgggaggtaaaattatccagtggatgattttagaaatccattaaatgaaagacttaatttttaagctcctcgctcattcatttctaggctcaggctaaaatagttccccgaactattttactctcaaaaattccgtcctatagaagcatatttgcttctataggataccactatggcgggaaatatcttttaaaagctcacttcgttcgcaaattttttgtagcaatctatttaataatgaacaataatctaaaactaaacagctgaacctataatagacatataaaaatccccacgcaaaataacttgcgtgaggacgaaattcgcggtgccacctcaattataggatttctcctatctctcattcctgtctcagatatttcctgtaacaggctgtgcgataaagggcactcccttgagaattatgtttttttctcttgtttcagatggacccaaccttacagttttctctgcttgtttccagcaaccacaagctctctgtgagagaaaagactgtaatttttccatcttttattttttagcttctaggtagtctgcaatcgcagctacgtccttgtctccacgaccagagacattgatgatgataatgtcgtctttacttagtttcggtgcacgtttaactgcttctgcgatagcatgcgaactttcaatcgctgggataattccttcagtcttgctgagaaggaggagagcctgaacagcttcttcgtctgtcgcagccacatattccacgcgacctgaatctttaaagtaggcgtgttctgggccaacccctggatagtccaatccagctgagatagagtaaactggagccaactctccgtcttccttaaagactgcataagtcttcatgccgtcgacaattccgatactaccttttgtcatagtagctgcgtgcttgtctgtgtcaagtccatgtccagcagcttcgaccccaaccaatttaacttcttcatcagccacatactgagaaaaagcaccgatggcattggaaccaccacctacacaagcaataacgtagtctggtaagcgtccttctttttctaagatttgacggcgagattcttcactgatgaccttttggaactcgtggacaattgtaggataagggtgaggacctacagcagatcccagaacatagaaggcttcaaggtcattcatccatgctccaaaggctgcatcaacagcatctttaagggtacgagtccctgtttcaactgcgtgaacagttgctcccatcatctccatacggaaaacattgagacgttgacgttccacatcctctgcccccatgtagacatcacaggccataccaaacttggctgcagctgccgccgtcgcaaccccgtgctgaccagctcctgtttctgcgattactcgttttttgcccatacgtttggccaaaagaatctgtcctaaaacgttgtttagcttgtgagaaccaaggtggttaaggtcttcacgtttgagataaatcttagcgccacctaagtggtctgtcaaactttccgcaaaatagagcggtgtttcgcgacctgaatagtcctttaagtaatggcgaaattctgccaaaaactctggatcatccttgtacttgtcaaatgtcacttccaactcatccaacaaagcctgaatcggctccggtacaaaactaccaccaaattgtccaaaataacctttagttgtcataaaattttcctctttctgtattggttccaagatatgaaaaaagcccacacacagaatctacttctgcgtgagggcgttggtaacgcggtgccacctcaattataaagggactatcccctttacatctctaccttgtctaacaacaagttgcactgtaaggtgtgcgcaccgaactttcattgtttcaaattcatttttaaaatcagcccactttcactacttccaaccacctgttcacaatcaccacaggctccctgaagatcaaaaataattacttttctgatttattgaacttattttaatactttgttttttctttgtcaagacttttttacaatttttttgatgaagctagtactttttcagaaactgttttgaaagtctcaatgatatagtccacttcttcatcgcttaatttagtgtgaagagggagcgtaatttcattttcaaagaaggcataagccttaggatagttcgccatatcaaaaccaagattcttataggctgtcaaaagcggaagcggtttgtagtggacattgcttgcaattcctgctttagctaattcttggataataagattgcgttcttctaaactcgctccttctacatgggtgatgtagaggtggcgtgaagattcgacagtttcagtcttgtgtgccaatggatggatacgagaacctgcaaaaccacgatcatagcggttcacgatctccttacgacgttctagcaaacttgggtagcggtccaattgtaccaaaccaagggaagccataatatcggtcatattacacttgtaggctggtgtgacgatatcgtattcccatgaacccagttgcatcttggcaagagcatccttagtttgcccgtgaagggaaagaatttggaattccttgtacatctcttcgtcgtcaatcgctggattggctttccaagtggcacttccaccttctgcagttgtaaagttcttaacggcgtggaatgagaaggaagtaaagtcagcgatagaaccagctggttgccctttataagtagatcccaaagcatgggcactatcagaaacaatcacgatacggttaaagggctttttgccacttgcttgaagcggtaaagagatcacgtttcttctccacaacttggaacaaacggtcgtagtcgcaaacaatccctgcaagctctactgggatgatcaccttggtcttttcagtgatagcttgctcaagcaggtcatagtccatctcaaacgtatctgcttggatatccaccatgacaggagttgctcccacgtgagtgatgacactacatgaagctgtataggtcatggctggaacgatgacttcatcaccaggtcccacttccaagacgcgcaaaatcaactcaagagcggcagtcgcagagttgaggcagacggtcttaggtgtctgtgtatattgagacaagcgacgctctagttcttttgtcttaggacctgttgtgatccaaccagaacgcagggtatccgctacttcagcaatttctgcttccgtaatatcgggtggtgaaaatggaatattgtaatttggcattgatttgctccttttatctgtactcattttcttatgactactttattttagcacttcaaacacggtttgaaacatgattttgatgtctccaaggaaactaaactctcggagataggcgaggttatagcgcatcttttcaggaaggacgtgttcgacataggcctggtcaactgacaaacctttctccgtcatttgactgatgatggtgtcctcatccttgtagttgatgctggctggagaggtaatccctgctggtaaaagcaaagtcgccatcatttcagggctatactgctctgtgtagcgtggcacttcaggtcgtgtaccgacaaaggacatctcacctttaaggacattgaccaactgaggcagttcgtccaaacggacacggcggatgaaattgccaaccttagtgatgcggctatcgttagcagaagtcaccagacttccttttttatccgcatccgtcaccatggtacggaacttccaaatcttgaaaggtcgattgtactgggtcacgcgctcttgcttgtaaatcactggccccttgctatccaacttgatccaaatgctcaaaatgagaaagatgggagaggtcagaaccagtacaaccaaggccaaaacccagtccaaacaacgcttgaaaatcagcgaacccttccttttagagacaagctggtagtaagactcaacctcgcttgatttcatttccacgggcaagtcttcccatttcagcatgctgtttctcctttgtttttattatactatttgtcaacatttttcattataccacaaaatggaaaaggcggtgaaagaaatctgtaatttgaaggatttccttcttacactcaatgaaaatcaaagagtaaactagaaagctagacgcaggctgctcaaaatatagctttgaggttgcagataaaactgacatggcttgaatagattttcaaagagtattaggccatggcccctacctgcaaactatacatcttgtgataggttcctcccaaggccaaaagttcctcatggcttccactctcgataatgcgccccttgtccaaaacatagatacagttggcgtcttggatggtagaaaggcggtgagcaatggcaatggttgttcgtccctgtctcatcttagccagtgaagcttgaaccagactttctgtttcagagtcaatatttgctgtcgcttcatccaaaatcaagattttgggctgactggcaactgttctagcaaaggcaagaagctggcgctgtccagttgaaaagctcgaaccacgctcggacacaggtgagtcgtaaccctgaggaaggtcttgaataaaggaatctgcatccacgaaggctgcagcagcctggacctgctcatcactaatgtcttggtacatggcgatattggacttaatggttccatgatagaggaagggttcctgcaagaccagaccgatgttttttctcagctcttcctgactgtagtccctaatatccacatcgtccaagagaactcgccctgattgaaattcataaaagcgcatgaggacattaataatcgaagatttccctgaacctgtatggcctacaaatgcaatggtttcacccttgttaaccgaaaaggaaatatcatccagaatctgatgtttcccgtcatatgagaaacacacatgttcaaaacggatattgccttctttgactttagcctggccattttcttgaagaggttcataggtcctctcgtctatcagggaaaagacacgacctgcagaaaccatagacgtttgcagggttgagaagttttgcgtcacttcaatcaagggatcaaagagacgattgatatactggataaaggcatacatggttcctgccgttattcccagataaagaccacgatagccaaaataggccatcaaaacagcgtatcctagaagtttcagtaaactcatggcaggacgcaaaaagagagcatccaaggctacagaacggttggcatagaccaagtgttcttggttgatttcatcgaattccgcctgcaggcgcttctcttgattaaaggcctgaataatcctgatgccctcgatattctctgccagcttactattgatatctgacaagagacttctggttttctcaatgattttcactgattttttccgatagagattgaccaaaaggaagatcaaggggagaaagagcaagactaatgctgtcaaacgaaaatccaataccaacatggtataaagagttgtcagaaagatgaaaactgctgagataaagctagataaaatccccgaaaacatatcgctgatggtctcggtgtcatttgtcaaacgagagacgatagagcctgctggtgtcttgtcaaaataggacatgcccaatttctccatattggcaaaggcatcccgacgaatatccctaacaatactgtatgacacccgtgcaaagagaagattaccgacatactgaactacagtttgtaggatataaaggccatagtaggccagcaaaacggtaatggctagttggttaagattactcagatactggtcgataaagtgggaagccacaaggggaatgacacttttgatgaccgtcgtcgctaggagaaaactgagtgccaaaaaggtcaggaggccgtaaggcttgagataggacatcaagcgcttcaatacagtccattgttctttcttattctgcatcttcttctcctttcatttccatctgctgagactggtaggtttgggcataccagccatccaaagctagcaagtcttcgtgtgtgccctgttcaataatttgaccattttgcagaaccaagattagatctgcatggacaactgcactcaggcgatgagccgtaataatggttgtcttgtcctttcgcgtctccttaaggttgtcgataatcgcatattctgtcttggcatccacggccgacaaagaatcatccaaaatcaagatatctggatctaaaatcatagcccgactcatggccagacgctgcttttgaccaccagaaagactgactcccttttcaccgataatggtctcaaatccctgaggcatgtctacaatgtcttgataaacttgagctagcttagtcgcttcctcgactgcagaaagggtcaagttcggatttccaaagcgaatattgtctaagatagaagtcgcaaagaggaattgatcctgaggaacataacccataagactacgaaggtctgtcagacgataatctctaatatcatgaccatttagataaatggctcccttgtccacatcgtattcacgcaagagaagcttaatcaaggacgtttttccagagcctgtctgaccaaccaagcccagtgtttgccctttttccaagctaaagtgaatatccgtcagtgtttcctcattttcaaaggcaaagctatcaatatcatactgcaagcgcccgtttacaatgccatctaaaggaaactcaggatcttgtacaggtgattcctgagacaagagttcctcaatccgctggtaggaaaccttccctcgctgagtgatattaaagaggaaaccgatagccataagaggccaaaccagcatatccaagtagctgataaaggtaaccagatttccaaccgtgattttcccttcctgaaccatcaaggaaccgaccaaaagcgttaaaacataggaggagccaacaaacaagagaaccatggggtcaaagagactatcgtatttcatggtttgcaggttcttttggaaggtcaattcattgactgcctgaaaagactccagctcgtctgcctgataaccgaaagatttggtcactttgatacctgatacagactcctgcaccttgttattgagttcagaaaaggcagcttgggactctccaaaggctctgtgagtctttctacctagacgactggtcgcataggccatgaaaggcaggggaagaatggcaaccaaggtcatttgccatgaaatgctaaagagcatggtcaacaaggtcactaaagctgtgattgaggcatccaccgctgacataacccctccccctgccagacgcgttaaggcattgatatcgttggttgcgtgtgccatcaggtcccccgtcctataggtttgataaaaggctggagacatttttgtgaaatgctcaaataagcgagagcgcataatctgtcccaaacggtaggaagtaccgaggatatacatacgccaaacatagcgcagatagtacatcccaaaggcagcaagtagcaagtaaaataggtcaagaaggaggtcctgctgggttaattgtcccgatgtgatggcatcaatgacccgccccatgaccataggtggaatgagattgaggacggaaaccaagaccagggccacaattccgactagataacggcgtttttctaacttgaaaaaccaccaaagtttttgaataatggacataaaatccctttctgattgcaaatgaaaacctgaggccaatactcaatgaaaatcaaagagcaaactaggaaactagccgcaggctgtactcgagtacggcaaggcgacgttgacgcagtttgaatttgattttcgaagagtacaagaccccaggtttttcttattcataggttacgactgtgaccgcacccttgtcatactcagcgataaagatattggctacattgtcatgtccttgtttgctgaggttatcaagcagccattcttcgttacgaccaatcgactccaaaacatcgacttgtatcacaccgtcagtcacaactggatacttaggattttcatcccccatttggaccacgatgagttggccattttgctcctgcacagctcgtttgacttgcttcatctggaaaattccttggctacgaagtttgagggctacttccgatgcagacaagccaactgaacgacaggcttctgggtcaatctgcccatttttgataaggagagttggttttccatcaatcaagcgtttgacaaaacgaacattgttattgagccacttgagggtcaagaccaaaatcgtccacatcatcaaaatcactgcatactggagaatgctgatagaactattgtaaatcaccccaccgatgataccaccgagaacatagttctgaatttggtctgtcgcagagttaggtgctaggttcccctttcctgtcacattgataacaaaaacaagcgagaagagccccaaggccagtttgattaaaatttccatataattgagtgtcatttgtttacctccaccaattcaatagcgtctgtttgattcaattctaatttctctaaaagatacttgtctggttggctcccgttcatggcgcggtagaaatttggacctaccttgacaagcgctccatcagtggctgcagaagtattgacataaacttctgatttatccactcccaagtctttggaaacaacctctatgaaatgaagggaggtttgaaattggttgttagaggcttgattggtctggtattttgagattgtcaccaaaagcatggccaccaaggtcaaggccaaaatcatgaccaattcccgaaacttagtcccctttttatctcgataggcttttaaagcaaaaaatcctgtgatagctaggagaacaattccaaagccaatcatgatgccattttgctgactgatttggctaagtacatagtcatatgagtaaaatttcatttattttcactccctttcataaaatcattcttaattataaacgaaagagagtgatttttcaagccatacgttggggaaatggacctttttttggtataataaaatctataatctgaatgaaaaaggtaactttatgaaactcatctcatggaatattgattccctcaatgctgccctaactagtgactcaactcgtgccaaattgtcccaagaagtactacaaaccttggtcgctgaaaatgctgatatcatcgctatccaagaaaccaagctttctgccaaggggcctacaaagaaacacttggaaattttagaagaactcttcccagactacgaaaacaagtggcgctcttcccaagagcctgcccgtaaaggctatgctggaaccatgttcctttacaagaaagaactcacacccactgtcacttttccagaaatcggtgccccttctaccatggacttggaaggccgcatcatcactttggaatttgataaatttttcgtgacccaagtttacactccaaacactggcgacggtctcaaacgcttggaagaacgccagatctgggatgtcaaatatgcggagtacttggctgaactagacaaagaaaaaccagtccttgcatccggtgactacaatgtggcccacaatgaaatcgaccttgcaaatcctgctagcaaccgccgttcaccaggatttaccgacgaggaacgtgctggatttaccaaccttttagcaactggatttactgataccttccgccacattcacggcgatgtcccagaacgctacacttggtgggcacaacgcagcaagacttctaaaatcaacaatacaggctggagaatcgactactggctcacaagtaaccgcatcgctgacaaggtgaccaagtccgatatgatcgactctggagctcgccaagaccatacaccgattgtcttggagattgaactctaaggagaaaacgaatggactatcaagctgtcattcctgaatttgtagtatctgacatcgaaaaatcacgccacttctactgcgacttgctgggattttctgtcgaatacaagcgtccagaggagaaatttctcttcctctcgcttgaagactgccaacttatgctagaagaaggcagcacagaagaattagcccaactaacctatcctttcgggcgcggtgtcaatatttcctttggcattgaagatgtccctcagctccaccaaaaactgctggaagctgactatcctatccatcgtccgctgaccaaaagagaatttcgagtgggagatagctttatttaccctcatgaatttgcgattttggatccagatggctattttttaagatttagcgagtagaataataaagattgggaaaaagtctttaaagttaaaaaggcatattatcaagtcttgagaaatcttgataatatgccttttatgatagaaaagccttctaaatgttagccaataagttgatttttgcccgtttttattatatttgttcgttttttatttcaaaacattaacaaaacatttgatttctaaagttatttagtgtaaaataaaaacattggctcaagcctattttaaattaaatatcgttttacttgtttatgtcgtgaattggcacgacgtttctacaaggtgccggaacacctaacaataagtaagtcagagtgaggtatgggtgttttgccatgcctattttggggacttacttagagattaagtaggccccttttgaatatttttaatatttcccttaattagtgtggacgggagcaacttccttcggaatttcatccctaatttttgagccaaaagtctcaaaaattccgtcatagacaataacaaacttattgtctatgataccactacaacaggaaatatttgataagactcgcttcgctcgtactagttttatcaaatatatagtactagcaaactggatcaccatagaaacatttaaccaacaagtaaactggcttttagactttaggaggtcttatgaaattattagaagagcgcatcctcaaggatgggcatatcttgggtgacaacatcctcaaggtggattcctttttaacccaccaagttgactttagcttgatgagagagattggtaaggtttttgcggaaaaatttgcttctgctggcattaccaaggtcgtaaccattgaagcgtcaggtattgccccagccatttttacagcggaatccttaaacgttcccatgattttcgccaaaaaagctaagaacatcactatgaacgaaggaatcttaactgccgaagtttactcctttaccaagcaggtaaccagcaccgtttctatcgctggcaaatttctctcaccagaggacaaggtcttgattattgacgattttcttgctaatggccaagctgccaaaggcttgattcaaatcatcgaacaggctggagcaacagtcgaagctatcggtattgtgattgaaaaatctttccaagatggccgtgatttgcttgaaaaagcaggctatcctgtcctatcactcgctcgtttggatcgttttgaaaatggtcaagttatttttaaggaggcagatctctaatgcaaactcaagaaaaacattcgcaagcagccgttcttggcttgcaacacttactagccatgtactcagggtccattctggttcctatcatgattgcgacagcccttggctattcgactgagcagttgacctacctgatttccacagatatcttcatgtgtggtgtggcaaccttcctccaactccaactcaacaaatactttgggattggacttccagtcgttcttggagttgccttccagtcggtagctcccttgattatgattgggcaaagccatggtagtggtgctatgtttggtgcccttatcgcatcagggatttacgtggttcttgtttcaggcatcttctcaaaagtggccaatctcttcccatctatcgtaacaggatctgttattaccacgattggtttaaccttgattcctgttgctattggaaatatgggaaataacgttccagaaccaactggtcaaagtctcttgcttgcagctatcactgttctgattatcctcttgatcaacatctttaccaaaggatttatcaagtctatctctattttgattggtttggttgttggaactgccattgctgccagcatgggcttggttgatttctctcctgttgcggcagcaccacttgtccatgtcccaactccactctactttgggatgccaacctttgaaatctcatctattatcatgatgtgtatcatcgcaacggtttctatggttgagtcaactggtgtttacctagccttgtctgatatcacgaaagatccaatcgatagcacacgccttcgcaacggttaccgcgcagaaggtttggccgttcttctcggaggaatctttaacaccttcccttacacaggattttcacaaaacgttggtttggttaaattgtcaggtatcaagactcgcctaccaatctactacgcagctggtttcctggttctccttggactccttcctaagtttggcgcccttgcccaaatcattccaaaccctgtcctcggtggtgccatgctggtgatgtttggttttgtatctattcaagggatgcaaatcctcgctcgtgttgactttgctaacaatgaacataactttcttatcgcagcagtatccatagctgcaggtgtcggactcaacaacagtaatctctttgtcagcatgccgacagccttccaaatgttcttctcaaacggaatcgtcgtagccagcctactcgccattgccctcaatgctgtattaaatcataaaaagaaataagaaaaagaggtgtagacctcttttttctatatccttacctgtctttcttctgacctctggcctgtgacaaacatggtaaaggttgctttgcagacatttctgccttcttgattggtgatatccacatccaccacacaggttgtgcgaccttgatggacacattctcctttaatagtcagcacatcatcaagttttcctgctttgaggtagttgatagaggattggagcgtcactccgtctaatcctagcgagataaccaccaaaccactgatctggtcacaaagggtaaagagatagccaccatgagcattgccatagtagttgagcgacgagtccactactttggtcgtcaccacaacgtgaccatctctcatttgttcaatttcgtaattttcaaaggcagatatagcgtcaaaatgaaaatctttcatcgtttcctcctgatatttcaaacgacactatgatactactttttataggactgtgcaaggagaaagctcctagtctggcaaaattccgacctgctccacaaatcgcataaaggccgcctgtccttgttctgtctgcttgtagactcctgcatcctcaagtacacgcgcaaagatagtacccacagagtccttgacgatttcaagggctttttctttatccgttagatctggatggtgggctctgagttggtctgcccattcctgatgataatcggcaactgtaacagcttctcctacaagatagctagcaacttgctccacttcttctttcagacgtggtggcaggattgccaagcccatgacctcaatcaaaccgatattttccttcttgatatgttggacatccttgtggggatgatagataccatcaggatgctctggcgatgtttgattatctcgtaaaaccaagtccaactcaaactgtccatcgcgtttacgcgcaatcggtgtgatggtgtgatgcggtgtcccatcagtctcagctaaaatctgcacactaggatctgaatactgacgccattcctgtaaaatcttgtcagccaagttgatcaaatcctctttggaatccgaagtcaaacgcaacactgacataggccacttgacaattccagccttgacctgctcaaaaccagcaaatcggaaagacttttgcaagggagccaattccataggaaatacgtgacgacctccttgatagtgatcatgagttagaatagagccccccacaatcggcaagtcggcattagatccagcaaaatatcctggaaactgctctacgatagccaacagacgttcaaaactctgacgactaatggccatgggacgatgctggccatctaagaaaatacagtgctcattaaagtaagcatagggcgaatactggaagccccactcctgaccaaccatttcaaaacggataatacggtggttactgcgagctgggtggttgacccgaccatggtagccctcattctctagacaaagctgacactgaggataattactaacttgcaccaacttggctgccgcaatctctttgggatccttttcaggcttagagaggttgatggtaatttcaagttcaccgtaatcagatggaacacgataagcaatatttttagcaatggccttgagtttgatgtagtcatttttctgactgagttggtaaaaatcctctatcgattgctcaggagagtgggcataggtttcccagaagtcacgattgacctgactcggacaaggagtcaccaagtccatcagttcagcaccaaggatttcacgtgcagtctgactatcctcaatcatctctaatcgaacggcttcctcaaccagctggtccttgaggtcaatcactttatccagatccgtctcaacttccaaaacaccgtctcccactcgtgccaagacacgattggtcaggtagattcgatccatttcctcaaatgaactttcagaaatgacatgtgttacaaatttatctactaaggtcactatagagcctccttttaactagtcaaggacgcgagtgccacctgcaacttcagcgatatagaagcttggagcgtagccaactacttcctcgtagtgtttgcctacagcttccttaaaagcctcaacagtatctttttgaaccaaggcaatggcacatccaccaaaacctgcccctgtcatacgagcaccgagaacaccttcttgtgtccaagctgtgtgaacaagagtatccaattccaaaccagttacttcatagtcatgctccagagaaacgtgtgacgcattcatcaaacgaccaaatgtttccaaatctcctgcttgaagggctacttgagctttgagggtacgttggttttcaagcacagcatggcgagcacgtttcaaacgattttcatctttaatcagatagctgtattggtcaaaggcccactcatccaattcacccaaggtctgaatatctaaagcaacttgcaattcttccactgctttttcacactcagcacgacgttcattgtatttagaatccgccaattcacggcgtttgttagtgttcataataacaacgacattgtccttcaaatcaagtggtaccaaatcatactctaaagtgttagtatctaagtaaatagcacgttggtctgcacccataccgatagcaaactggtccataatgccagagttgactccgataaagttgttttctgtttgttttccgattttaaccaaatcgagacgctctaattttaaatcaaagagatgctctgccacgacccctgtcaaaagttccaaggatgctgaagaagacaaaccagcaccatttgggatattcccataaacaaagaaatcaaaacctttgtcaatcacatgaccagcttcttgcaagaaatgaagaaccccttttggataattggtccaattgtgctctttttcaaacttgaggtcagcgagaggcacttcgataatgcccttgtcctcaaaattagctgagtagaaacgtaaaacttggtcgtcacgcttacgagctgcaccgtaagttcccaaggaaatagcagctggaaaaacgtgcccaccgttgtagtccgtgtgttcaccaatcaaattgatacgacctggtgaaaagaaagtttggtctgcttcttgatcaaaaacagcaagaaagtctttgcgaagtgcttctgcagtaagatgttgtgtcatttgaattctcctttgactgtccgttaagccaccttaacatgtaatcgttttcttctattgtatccaagggattttccaaggtcaatcctttttactaaaattttactaaactatcagtaaaaagcagaaaaatatgatatactaaccttaaagaaggaggatttatggctaccttaaaagacattgcacagctagcctctgtctctatcgcgaccgtatcccgcgtcctcaatcgcgaccagagcctatctgttacagaagaaaccagacaccgtattttaaccgttgctgaagaactgggctacaccaagcacctcaagacaggcgattcccacaaacccaagcaaaagattgccattatccaatgggtcagtgaacaaggagaactggacgacctttactactaccagattcgcttgggtattgaaaaaagagcccaagagttggactatgatatcttgcgctattttaatgaccatccttttaccctaagcgaggaagtgattgggattctctgcatcggaaagtttagtcgagctcagatttctgcctttgaagaataccaaaagcctcttgtatttctagacagcgatacactttccctgggacatacctgcattatcacagacttttacactgccatgaaacaggttgtcgattattttctcagccaagggatggaccgcatcgggattctaacaggccttgaagaaacaaccgaccaagaagaaatcattgaggataagcgactggaaaattttagaaactacagtcaaacaaaaggaatctatcatgatgaattagtctttcaaggaagctttaccgcccagtctggctatgacttgatgaaggaggccattcagaacttgggagaccaactcccaccagccttttttgcagctagcgatagtttagccatcggtgccctccgtgcgctccaagaagctggaatcaacctgccagaccgcgtcagtcttatttcctttaacgatactagcctgaccaagcaagtctatcctcccctctctagcatcaccgtctataccgaagaaatgggccgagcaggtatggatattcttaataaggaagtactccacggtcggaaaatccctagcctaaccatgctgggaaccagactgacattgagagagagtactctgccataactccacaaattaaaaatgacaaaaaatcctaatagagagtctcaaatctccattaggattttcttttttaggccatcacaatcatagacttaatggtcttacgttcatccatatctttataagcttgatcaatatcttctaatttatagcttgaagtaaagacacggcctggattgatatcaccatcaaggacggcttttagtaaaaattgcttatcatatgttgtcgcagaagctgccccacctgctacagagatattttgcataaatgtcgaaccaagagcacgattattatagtgtgggactcctacaaatcccatacgccctccattatgaaggacacctagcgcctgttctacagcagcctccgtaccaacacattcaagtgctgcgtctgctccgccaccgagaatttcacgcaccttggcaataccttcttgacctcgctcagctacaacagctgtcgcacccgactccagagccatcttttgacgatcttcatgacgactcataaggataatttgcgatgcaccacgcatcttcgccgcgatgacagcacattgaccaacagcaccatcaccgataacaacaaccttgttccctttttgaacatttgcaactcgcgccgcatgatagcctgtcggcataacatctgcaagagtcaagagggactttagcataccttctgtgtagtcagaaggttgtccagggattttaaccagcgcccagtttgcatagtgaaaacgaatatattccgcctgaaaatcgcctcccaagttattaccaatatgattgtcgcaagaaccgtcaaaaccagcaagacaggcatcacattcaccacatccatgagtaaaagggacaatgacaaaatcacctggtttcaccgtcgtaatggattccccagtttcttcgacaatcccaatcgcttcgtgtccactatttttgtgtccagctttcgtttctggattacggtacctccatagatccgatccgcaaacgcacgcacgaactacacgaataatcgcatcatctgcgtctataatttgcggacgttcaattgtagcaagaccaacctgacctgcctttgtatatactgctgatttcatttaaatttttccttccttgtaaagtttaattttgagatttaagcgatttaaagccacctgtaactgagacaagcgctcctctaattttttcttttcctcttctaaaataccaagccttttctctcgcgtttcatcccccttttggtagagagacatatagtcaactaaactatctacagagacacctgccgaacgaaaacacttaataaattccagagcttcaatatcatgatcttgaaaatcacgaattccagttgcagttcgagtaatcggtggcacaagaccaacccgttcatagtaccgaatcgtatccgctgaaattcccaacaagtcactagcagatttaatattcatacactaacctcctctcattcactgaatttaagctattctaactcacttatcttattatataattttgagttgactccaagtcaagcattttgcgtctaatcgaaaaattttttatcattatcagttctcttattagcataccttttcatcaatcaaagaaagaggttggggaaagcgtctttcaaatatgataccaaagaaactggaaaaaaagtctttaaaagcaaaaagcgcatagtatcagacattgaaaacccttgatactatacgtttttttgtatgaagatttacttcattttctcttgaaattgagttttgtctcagccgctttttctagtgttgatgcccatgggattgccctaaggctgttacctttcgcttatgttgcgcatgattgctttgactggtgtccacttcgatagtaatattctgcacacctctttcttctaagagctgacgtacttgattctttgtttccgtcatctcctcccaatcctctaaacagatatggataatagcattattttctagaccatccatggaccaaatgctaagttgattgacacttttgacattggtcagagcctccaaatccttctccaaatcacctgtctctagtccttctggcacagcatccaggaaaatcttgagtgcgctccaaaatcgaggaatagcttttgttagaatgaagatggaaatgacaagcgataagagcggatcaaggatataccaatctgtaaatcggaggataatcgccattagaatgacagccaaccaacctagagtatcttccaaaaagtgcaggctcagaattgactcgttctttgtctttcccttacgaactactagactagctagcacattgatactgactgcaatgattcctagccagaggacgccttcgtcattaacgggctgtggattcaaaagtttagttatattttccaagatcactagaatggatcctgtgataagaatcacagcagtcactagggcccctaaaagactaaatcgcttgtaacccaaggtgtattgcctatcttcttctctatttgagattgtttctaaaaaggccgatatgccgattgctatagcatctcccaagtcatggatagaatcagcaagaacagcacttgaaccgaagattcctcctgcgataaactcaacaatagcatagcttaaatttaagaaaaaagctacccaaacagtatattttgccttcatctttctcattcctttgttataatagatttatgaataccttgttcattatcattatccactaaaactcaaagaaaggatagaagcaaaacgtcagctttattcatttctgaacaatttgcctcaagtgtccatatgactaccattgaccgccgtatcagcaaaacaaaaaaagccatctatcaagcttttctacaacttttaaacgataagggttacgaagccactacagttcaggatatcattgatctcgcagatgtgggacgatccaccttttactgtcactatgagagtaaggaactacttctggacgcgctttgccgccacctcttccatcatctctttgaaagagagcaacccatttcaactgaggactacctcgcccacctctttctccattttcagaaaaaccaagaccatatcaccagtttactattctccaagaatgactacttcctccgtcaactccggagagagctggagcaccacgtctatcccatgctaactgatgagtttaaagaagcacacccaagtctgcctgcttcttacctccaacacttagtcgtgtccaactttatcgagacattgacctggtggctcaaaaaaggacaagactttacagaccaagaagttgtgcagttttatctagaccttctcattcctaaaaattgaatacagattaaagctcggttgccttatttctaggctactgagttttttatcttttcaataatcaaaaaagcccagacgacattgtctgagcgttcttctatattgtcgtttaaccaagttgagtttagcttttcaggctatttcttcaacaaaccttgttcttgtagaaactccttggctacttgctctgctgacttgccttcaacaccgacttggtagttgagctggctcatctggctttcagtaattttaccagccagtttattgagaactgtttccaactctggatgtttcttgagaagagcttctttcatcagtggagctccttgataaggtgggaagagttgtttgtcatcttctaagacctgtaaatcataacgtgccaattctgcatcagtcgaataggcatccgtgatttgaatgtcacctgactgaattgcctgataacgaagagctggctccatagtcgctacattgagattgagaccatacattgactgcaagcccttatttccatcttcacggtcgttaaactcaagtgtaaagcctgccttcagctgcccttccacttttttcaagtccgaaatggtcttcaagccatattcttgagcaatttttttcggaacagctacagcataggtattttgataagacattggtttgagataggctagatgatcctgtttggcaataccatcacgcgccacctgataaacctgctctggctcatgactcactttaggtgatggctgaagtaaactttcagtcaccgtaccggtaaattcaggataaatatcaatatcaccttttttcagagcttcatagaggaagcttgttttcccaaaattcggtttaacagtcgcagtcatactggtattttcttcaattagcaacttatacatattggccaaaatttctggttctggacccaatttcccagcaatgatcaagttctctttctctttttgagctaagagggctggactataagacaaaccgagtaatatggtcaccaaggcaaaaccagaaaaaatcgtccgcaattttgctttttccatcacttttagtaggaagttaaaggcaatagcaagcactgcagaagaaagtgccccgatcaaaatcagactggcattattacggtcaattcccaaaaggataaaggaacccagcccccctgcaccaatcaaggccgccaaggttgccgtaccgataattaagacagctgccgtcctaatcccagacatcataacaggcatggcaagtggaatttcaaacttcttgagtcgctcccacctagtcatcccaaaggcaattccagcctcttgcagactcggatcaattccctttagcccagtgatggtattttgcaaaatcggaaaaatcgcataaatcactagagctgtcaaagcaggcaaggtcccaattcccatcaaggggataaagagtcctaacaaggccagagacgggatggtctggaaaatccctgcaatctgcaaaacccaatccgccaacttctcatgatagcgaagataaacagccaagggaatcgctataaagatggccagcaacaaggtcaaaagtgacaactgcaaatgttgagatagagctgtcaaccaatcactaaaacgatcctgaaaagttgcaattaaattagtcatgaacactacctccaaacaagtctgctacaaaatctgttgcaggagcttttaaaatcgtctcgggattcgccacctgacgaatctctccatcctgcaagacagcaatacggtccgccaatttcaaagcttcatccgtatcatgggtcacaaaaatcgttgtcatcccaaactctttatgcaattctttagtcagaacctgcaactgtttgcgagaaatagcatcaagagccgaaaaaggttcatccatgaggagaatcttaggctgaccaatcatagcccgtacaattccaacacgctgctgttctccaccagataattcattaggaagtcgatgtccatactcagccactggtaaaccaaccttagccaaaagctcttctgttttctgagcaatttcttccttagtccagcccttcatctcaggaatcagggcaatattttccgcaactgttaaattgggaaacagagcaatagcctgtaaaacataaccagtagaaagacgaagttcacgctcatcatagtctttgatgcgtttaccatccatataaatatttccatcagtcggttccaaaagacggttaatcatcttgatcatggtcgtcttacctgacccagaaggtccaactaaaaccataaactccccattcttaatccgtaaattaacatctctcaaaacatctttttctgtgtagcgcaagactacatttttgtattcaatcattctttgtcctcattttaaaactttcctcgattggtcaagtcttctaccttaggcataacttccttattatcccaatgctccacaattttcccgttttctagtcggaagctatcgtactgggcataggcaactccaccaatctgattctgaccatagctaaccacatagtttccttgtcctaagagttggaaaacaaagtcaaaagtggcctttacttataaacagctaatttgctccattttaaacctcattttcctcctctttcagattaaccaaaattctttcttgaaaggcttcaaactgacgaatttcttcctcggtgaatcctttataaaagatcgtatccaatttctgactgacacgatgccccacttctttctgagactgccccaactctgttaaaaccaaatacttcttacgcttatcttctccacatggactaatagttacaagattttgttcctctagttttttaatcatcgtcgtcagagtattattagcaagcccagtcgcaagcgcaatatctgtcgcagttgcgcagccagtttcactattccataaaaccgctaaaatcttcccctgttcactccgataaagagcatcaggatcttggctcagtaacttttgaaaaagccgcccattcaacaaacgaatatgatgagctagcaaatgactatctttcatgacacctccaatttatttccatatcgaaacgaataaaacaattgtaacactcatcgttccaactgtcaactatttcgatttagaaataatttttcccagtaaaaaaatctcctacccaaggtagaagatttcaatcttataaaacttaatccgtcatgtctgataccaacgttcgatgctccaatggaacactgcacataactagcaagaaaatgaaacctgactgaatccagaagagggccaagtcaaagattccgtgcacagcaaccactgtaaggaaagatagataaagaccgataatcgggcgtttccccgactcctgactcatatccatcatcaagcgaacaggagccacagaagacaaaactagtaaaatagtccctacaattccgtaactcagaatcgtatcaatataaagactgtgagcatgttcatgataaggagcatttatccgaggatacgagtgcatgtaggtcaatggcccttcaccccaaaaaggattttgcttaaacaaggccatcccagcatcccagatagaaatgcgttcttccatagaagagtctaaagtccccatccgaactcccaaatcactagaaaagaggaagctcaagccaatcgcaaagaccccaatactaagccaaaaggccttccagtttttaatggtcgtaaagagatagataatggcaccagcgataatagcaggaaaggcagttcgattttgcgtaaagttcaaaccaaagagattcacaaagcctgcaatcacacagaatactttcaaccaattcaacttggtcgttgtaaacagatagaaggcaatcatgatacagaaacaacaaataattccataataattaggattaaagaaggtcacttctgcacgattctgatgccacacctgcatgttaggtgaaagaaaagcatagttgaatttcttcacaatttggaaatgttctaaactcgcaaaagcagctgacaaaacgctaccaaacaagacgagctgcaaaatcaatcgaaagaatttatgtgataaaatcgactgataatgcaaaaagaaaacagtaaatagaaaaattcctactgaggccacaactcccatccaattttgtgcaaaaacggatataacagtactatagccaagaaaaagaagtagcatcggatgctcccccattttctgaagaatacttttcatgtctcctgtgaaaattaaactgataatatataaacagaatacaactacaaaaagataaaagggtaaaaagatactcaggataattcccaataaaatcagctctttactagacaaccctttcagcttttcaataaagcctattgatttcaaaatgaatcctttctctccaaatcagttgattcagataatagtaagctaccctttattgtaccacttttttagcaatttgaaaacaaaggaaacgttttctaaaataaaaaccctattttatcaaccatatcaagtcttcaaaatgttacttcaattccgttctcaattactcgataagtctgattttgcaaatcaatttctgctactgctgttacggacttatctttattttgacgtttgattacaatgctgtgggctgttggtgtttcaacgtcaatagttccttctaaatcaaatgctactgatcgattacggaaagaaaatagattgagaagggccttcactacaggacgttggacttcttctgctatttcctcattgctatagtaatgacgattaatatttcgacctactttagtttcttctaataatttcaaatcattcttgcctgctaatagacctacatagtaaacttgaggaatacctggagcaaatgcttgaattaatcgtgcaaggaaatacttgacatcatcatctccaagcgcagaataataggttgaattgatttggtagatatctaaattattatactcggcactggagtacttacgtttgacattagctccaaccttatagagttcatttgaagcatagtcaatctcctcatctgtcaagatatccttgacatccaccactccaatcccatcatgggtgtctagcgtcgtaaattgcttcattgggctcatctttaaccacttagccaaacgctctgttctggaactgtaaagagtataaagtgtcaccattggaagagcaaaatcataaacatagtaatcatggtctgctattttaaactgaatcgaataatgttcatgaatctcaggtaagagctctgtcccatactcagcagcgatatctcgaactttgtccaataaatcccaaatatctggttctacaaagaaatcattagtatccaatttcttcactgcataagcaaaggcgtctagacgaatcaaatcacacccattacttgccaagtgctgaatggtcttacggataaattccatagttacttctttggtcacatcaagatcaatctgctcctcaccaaaggtattccacaaatgttcgactgacccatcttcaaaaacaatctcttgctttggtgcacgatccttacgcttgtaaattaaatctacatcagactgtgtcggacggttttctggccaaaacttatcccagtttaaaaagagatctttaaattcactggcttcatgtttttcttgatagtccttataatacttagattgacgagaaatatgattaatcataaagtcaaacataagataatatttctcacctaaacgcttaacatcctcccaatcaccaaaagctgaatccacttcgtcgtagtcaactggcgcaaatccacgatcacctgttgatgggaaaaatggtagaaggtgaactcccccaatagcatctccaaaatactcttccaaattctcatataagtctttaagattatttcccagactatctgaataggtaatcaacatggttttattctgaattggcatcattactctcctttttctaattgaagccaagtcttatatgacttggcttcgtaaatcaagttcatgttatactcttcgaaaatctcttcaaatcacgtcagctttatctgcaacctcaaagctgtgctttgagcaacctgcggctagcttcctagtttgctctttgattttcattgagtattaaatctctgtttatcatcaaactcgtactaatatagactgtgataaactaagtactactttcttgttttctacatagaattatcaacaagctgaacccttcctctgtgtcaaagactatagattctatgagttcttcttacttcactgctccgttgctcatgcctgaaataatatgtttttggaagatgaggtagacgacagtaattgttacaattcctacaatataggatgcaaaacttggcccatagtcattaaaatactgaccttggtagttgtactggaagagaggcaaagtccacagcttggaatccttattcaaaattaacaatggcaacataaagtcattccagaaccataatgcattgataatcaaggttgtagcatgcatgggcttcagcattggaaaaataatccgacggtaagttgtaaatcgatcagccccatcaatttctgcagcttcatctaaactatctggtacactgattttaatataaccaacatacaagaagagagtctgtggaattgcataagttagataaagtagtaccaacccccacatatttgccaggccgagtttgctcatcataactgtgataggaatcataatcacctgaaatggaacaaatatccctaaaatcaatagtgaatacataattgcaaaggcttttttcttggacatatttcgagcaatggaataggctgcagctggtataaagaaggctactacaatcaatgataacaccgtaataacagctgaattccagaaatagcctccaatcccatccgaaaccaatcgttcataattgcttaatgtaaaaggattgggcaaaccaaagaaatgattcatgatatccttggttgtcttgaaggaactaaaaaccgttaccaacaaaggaacaagtatgagaataccacctactatcaagagaacatacttccaaaactgattcaatttttcttcttttttcatgtgtaagactcccctattagatttcaaatttctttgatagtttgatttggataagagaaacaattccaataattaagaataaaatcaaggcaattgcattcgcatatccatattgattactcttgaaggcatagttatagactaaaagaccaagagacgttgtagcattattaggaccaccactcgtcaaagcaaaaatttggtcaaaggcagtcaaaccggacttaagagctaggataaaaaccatagaaatcgttggcaacaaatatggtaattcaatcttccaaaaagtttgtttgcttgttgcaccatcaattgatgccgcctccaaaatatcagatggaatactctgaagaccagcaagaaagagaataattggcattgctactccttgccatagaagaacaaaaatagttgctactaccgcaccgatcggtgttcctaatagactttcttgtaaaaaactaatccctaaaatttttccaatcgttggaagaccatagttgaagaattgtttaaaaatcaaggaaactgtcaaaccagacaaaaccgccgggaaaaagaaccatgctctaaagaaggtctgccctttcatcttagaatttaaggctcgagcgacaaccatcccaattgtaatctctccaataatcaatgccagggttaaaatcaaagtaaaagcaatggctgtgaagaatttcccatcaatcatcagcaatttatagttattcagaccaacaaatttataattataggtcaatccagtccagttagtcaaactatagaaagcaccttgtaccatcggaaagtaaaagaagatagcttgtaatgcaagcgggatgagcaaaaaagtccaaccccagtatttatttaaaatttttcgaatagccatatcatcttaactcctattctagtccaaatctgccttcattggattaaagaaagcattgagattgtttgccatatttttcagatttttatccatcaagtaacctgcacttagattgaaaaaatcttcttcagaattccagtgttggcccaaccaaacataatgtttatccgtaaatgctagtttagaaatctctgcaagtgctgaatcttctttttcctgtatacctttcacagcaactggtgaaccatctacatcataatatgcctgcatagcttttggactagtcatatagctgataaattcttcggtttctttaggatgtttggtcgtagctgaagttgataatgccatgtcccctgcaccaacagtgacttcttttcctacttcttctcctgggaaggcaaacatccccacatcaaattttggatcctgttgattaattgccgctaatgcccatgatccttgtggcatcataaaagctttttcattcgagaatgctaccaccgcatcattataagaggcaccacgccatccatcttgagcattgtctgccaacaaatctagtcgttctgcatctgcttttaaaatagcatcatctacagaaatagcatttggttttgaaaagcgaagatagttattagctgcgtctccactgcctgtaatggtaatgagagaaagttggtgataaccgtttaatgtccatccttcattgcctgcaactgcaaacggagaattcccactatcttttatctttttaacaatctcttgaaactctttaaaagtcttcggttcctcaagtcctaattctttaaactttgttttattgtaatagattccataaaggttagcagttaaaggcacactataaatcttgttattgattgcatacttttctgcatagtcattcttaatattctcaagataagatttccctgtcatatctgcaaagtaacctgcttttgcccactcctgaaaatccatattttgaggatagatattaacaatatctggaacatctcctgataaaatccgagtcttcagaacaataccagctgccggaacagtcgtcagttttacatcaatagtaggatgatccttttcaaaattatctacaattttttgcaaagtatccgccatttcggtcttctggttaaaaaattcaatcgttacctttccatcagtcgattgattattctgaccacaagctgctagacctagtaaactagccccagcgactaaaagaaaacctgctttcttataccatttcattggaaagcctcctttataaatttatacacctttattatagtcttctaaaaatatactgtctactcaaaaaatctccttgggataagataacagttaagcctgcatacatgagttctgcacctgagtaaacttctccattttcctgtaattcatacagtccctcttcatccaaatcttttaactttaaagttgtttccatggtctctacaactgacaaaacgcgaacgtaggttacaatcgtttgatttttgtaattaaattgtacagctgcttcattggatgcagactcgggattgattaacctatactgttgtcctaactgaactactggtcgtaattctttatacaagttcacctgattagcaatctcagctttctcttcatctgataaacttgtcaaatcaagctcatatcccaaatttcccatcattgctacatgaccacgtgtttctaatggtgtcgttcgccccatctgatgattcggtactgctgacacatgagcccccatagaaatggttggatagagataagatgaaccgtattgaattggtaaacgtgcaatagcatcagtattatcactagtccagacttgtgggaaatagcgcatcatacccagatcatttcgtccaccaccaccagagcaggactcaaagagaatatggctgtgcttctctgtcagataagaaacgagttcgtaaagccccaacatgtactgatgagattgcatctttgtctctagataagtaaagccatttcctaggttggtcatattacgattcatatcccatttaatataatcaatctcatgataagataggagttgatctaagacatttttcaagtattctactacctgaggattggcaagattaagtactaattgattccgagaataagtatgctcataaccaggaacctgaatagcccagtcaggatgtttacgatacaaatcactatctacagaaatcatttcaggttctaaccaaagtccaaactgcaaacctctttcatggatagctgaaatcagactttctaggcttccacccagttttttctcattaacaacccaatcacctaaagcacgattatcatcaaaacgattgccaaaccaaccatcatctaatacaaaaagttcaatgccaactttcttagcttcatcagctagctctaacagtttttctctctgaaagtcaaagtaagtagcttcccagttattaattagaattgggcgttcttttgtagaaaatttacttggcataatgtgcttcagtacaaaattctgacttgcatgactaacaccagttaatcccttgtctgaataggtcattaaagctaccggtgtttcaaagtattcctcagggtctaacttccaagaaaagttttccggattaatcccaatagccagccgaacttcattcaattgattcttttgaacaaaagcttcaaagtttccactatacattagttgaatagcaaacacattccctgcatcctctgtgattccttgatcacagagtagaagagctggtgtttgagcatgcccagaagctccacggttcgaactaattgaaaagattccttgttctacctgttgacgtcgaacagtcttttcacgagcataagcaccctgcagagttacgatttcgtaagctgccgctggaaaatcagccataaaagaaaagtctttatgaatgacaacttcctgattactattattcactaatttactgtagctagcaatagtcgaatcattatcaaaagcagtataatacaaattcagactaagttgagccttagaatcttctaacattaagacaagagtctctgtattatccatgctatgtggagaaggtaagccctgtggaccattctgtacctttttaaactttttgcttctacaaatcgaaagtctgttacttcagttacactatgctgaatctgtatagttggtttcctaaaatctcctaagccatgttgcccaaaaatatgacgttgagtatctaaactaaaggttcgattagtagctgttggatttcctgaaaaggcatggtcccgttcataaacactattggaacctttatagttcttaatagtctttcctaaatgtttcaaaagtaagtagccatttcgattttcaataatcaaacttagatttttactttcaacataaaatagattattctctatcctaactcccatttacttcacctcatcactttatagattatattttatcatctgaaaacgctttccgaaatagaaaaatgtctcaagaatatggtaaaatgttaggtaggaggtagcacatgctagttttttcagaataccagactggaacaattgacctttccctaagcttttatggatatgaggaatgcacaccaaattactcttttggtccaacaattcgagatacatacgtcctacattacattactaaaggacaaggaaaatttcattacaagggtaaaattgttgatttaaaagaaggagatttctttctattaaaaccagatgaactaaccttttatcaagcagatagtaaagaaccttgggcctactactggttaggaatcactggagggaaagctcctgattattttgctctttctcaaatttctgaccaatcttatctcatccaatctgaaacttgtcatacccagactactgcaaaactcatctcagacattgtccgcttcgctcagattaccaaatcaaatgaattagctcaactccatatcatgggacaactccatgaactgatgtttcatctgggaactattgctcccaatcagaagaaaaagaatatttcatcgacccaccaactctatcttgaatgcaaacgattaattgatagccactatcctcaatcacttacaattcaagatttagcaaaagaactatccgttcacagaagctacttatcaagcgtattcaaagaatttaacaccttatctccaaaagaatacctactatacgttcgaatgtatcgagctaaacaactcctcgaaaatacccaagagtcaatcaaggtaattgcgtactcggtaggcttttcagatccactacatttttcgaaagcttataaacaatactttaatcagactccaagtcaaacaagaaaagaatattctcaacaccaactagtgagaaaggaaacactatgaaatcataccaagccgtctaccaaattctagctaaagaaaccgattatatcagcggagaaaagattgcagaagaactatcactgacccgaacatcaatttggaaagccatcaagcgtttagaacaagaaggcattgaaattgatagtatcaaaaacaaaggctataaactggtgaatggggatcttattcttccggaactcctagaacaaaatcttccaattaaaatcagttttaaatccgaaacaagatcaactcaactcgatgcaaaagaagcaattgatttagggaatgaagcaaacactctctatctagcttcctatcaaacagctggccgaggccgttttcaacgttctttctactcaccccaaggtggcatttatatgacactccatctcaaaccaaatcttccctatgagaaattaccatcctacacactacttgtagcaggagctatctacaaagccattaagaacctaactttaatagatgtcgacataaaatgggtcaatgacatctacctcaaaaatcataaaattggaggaatcctcactgaggcaacgacatctgtagaaacaggcttagtcacagatatcattattggagtaggaatcaactttactattaaagacttccctcaagaattaaaagaaaaagctgctagtttatttaatgtaccagcacctattaccagaaatgaattaattatcgaaatatggcgcactttcttcgaaacaccagcagatgagttgttatacctatataaaaaacagtcatttgttcttggaaaagaagttacttttacactagatcaaaaagactacaaaggacttgctaaaaatatctctgaaaatggaaagcttttggtgcaatgtgataacggaaaagaaatctggctcaatagcggagaaatttcactcaagaattggaagtaataataaacgagaacaaccataaaatggctctataatatttgtagtgggtaaatcccctatagatattatggagccgtttttattgtagaaaaaaagtcccataagatctataatgaaaagcgaccaaaccatcattagaaagaatcctatggaacaattacattttatcacaaaactactagacattaaagaccctaatatccaatttatggatgtcatcaataggaatacccacaaagaaatcatcgctaaactggactatgaggccccatcttgccctgattgtggaaggcaaatgaagaaatatgactttcaaaaaccgtctaagatcccttacatagaaacgactggtatggctactagaattctacttagaaaacgtcgttttaagtgctatcagtgttcaaaaatgatggttgctgagactcctctagtaaagaaaaatcatcaaatccctcgtatcatcaaccaaaaaattgctcagaagctgattgaaaaaacttctatgaccgatattgcccatcagctggccatctcaacttcaactgtcattcgcaagctcaatgacttccgttttaagtctgatttttctcgtctgcctgagattatgtcttgggatgagtactcctttacaaagggaaaaatgagtttcattgcacaagattttgaaaagctcaatatcatcactgttctcgagggaagaacacaagctattattcgaaattactttcttaaatatgatagagtcgtccgatgtcgagtgaaaatcattactatggatatgtttagcccttactatgacttggctaaaaagctttttccaaacgctaaaatcgtgttggatcgtttccatattgtccaacacatgagccgtgctatgagtcgtatgcgtgtccaaatcatgaatcagtttcatcgaaaatcccatgaatacaaggctatcaagcgttactggaaactcatccaacaagatagtcggaaactcagctataaacgtttttatcgccctacttttcgcatgcacttgacgaataaagaaattctagacaagcttttgagctattcagaagacttgaaacaccactaccatctctatcaactcttgctttttcactttcagaataaggaaccggataaatttttcgggctcattgaggacaatctaaagcaggttcatcctctttttcagactgtctttaaaaccttcctcaaggataaagagaaaattgccaacgcccttcaactaccctattccaacgccaaactggaagccaccaataatcttatcaaacttatcaagcgcaatgcctttggatttcggaactttgaaaacttcaaaaaacggatttttatcgctctgaatatcaaaaaagaaaggacgaaatttgtcctttctagatattagcttttcttcaacccactacagttgacaaagagcccataaaatcaacaatatataaagattttagcttttctgcaacccactacagttgcaaagagcgcaaaaaaacttcagataagtaatccaattaagttttacaaatctgaagtttttattctactattcttaaaaatacaaaaaaagagttataaactctcaataaaacggagaataagggattcgaacccttgcgccagttacccgacctaacgatttagcaaaccgtcctcttcagcctcttgagtaattctcctattaatgggcacgagtggactcgaaccaccgacctcacgcttatcaggcgtgcgctctaaccacctgagctacgcgcccaagttaaaaacttggtaatttgaacaaagttcaaagcgggtgacgagaatcgaactcgcgacaacagcttggaaggctgtagttttaccactaaactacacccgcataaatactataaataaaaatggcgcgagacggaatcgaaccgccgacacatggagcttcaatccattgctctaccaactgagctaccgagccttattgcgggagcaggatttgaacctacgaccttcgggttatgagcccgacgagctacctagctgctccatcccgcgttaatacaaaaggaggatgtgggattcgaacccacgcacgcttttacacgcctgacggttttcaagaccgttcccttcagccggacttgggtaatcctccatactattcaaatggaccttgtaggacttgaacctacgaccactcggttatgagccgagagctctaaccagctgagctaaaggtccaacaagatctttatagcggcgaaggggatcgaacccccgacctcccgggtatgaaccggacgctctagccagctgagctacaccgccatatatcgggaagacaggattcgaacctgcgacaccttggtcccaaaccaagtactctaccaagctgagctacttcccgagttaaatagaaaaatgcaccctagaggagtcgaacctctaaccgcctgattcgtagtcaggtactctatccagttgagctaagggtgctcattatattatgccgaggaccggaatcgaaccggtacgatcgttaccaatcgcaggattttaagtcctgtgcgtctgccagttccgccaccccggcctctctaagcgaacgacgggattcgaacccgcgacccccaccttggcaaggtggtgttctaccactgaactacgttcgcactgttttcttctatctaaaaatgccggctacatgacttgaacacgcgaccctctgattacaaatcagatgctctaccaactgagctaagccggctcatttattatatcttaatgcgggttaagggacttgaacccccacgccgttaagcgccagatcctaaatctggtgcgtctgccaattccgccaaacccgcatatatgacccgtactgggctcgaaccagtgacccattgattaaaagtcaattgctctaccaactgagctaacgagtctaaaataacttacgttattctaacggtcccgacgggaatcgaacccgcgatcttcgccgtgacagggcgacgtgataaccgctacactacgggacctttgggagttaacgggatcgaaccgctgaccctctgcttgtaaggcagatgctctcccagctgagctaaactccctagagctaagcgacttccatatctcacagggggcaacccccaactacttccggcgttctagggcttaacttctgtgttcggcatgggtacaggtgtatctcctaggctatcgtcacttaactctgagtaatacctactcaaaattgaatatctattcaaaccaagaaaaccgttcgctttcatattctcagttactttggataagtcctcgagctattagtattagtccgctacatgtgtcgccacacttccacttctaacctatctacctgatcatctctcagggctcttactgatataaaatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacaacgtctccttcgaaactggcgtcccgatctcatagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgacttaaagtcagcaccccttctcccgaagttacggggtcattttgccgagttccttaacgagagttctctcgctcacctgaggctactcgcctcgactacctgtgtcggtttgcggtacgggtagagtatgcttaaacgctagaagcttttcttggcagtgtgacgtcactaacttcgctactaaacttcgctccccatcacagctcaatgttacagatataagcatttgactcatatcacacctcactgcttagacagacacttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtacacnttcttcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaatccgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaggtacaaagactattttaaatacgaggctattactctctttggctgatcttcccaaatcattcttctataatctttgagtccacattgcagtcctacaaccccgaagagtaaactcttcggtttgccctcctgccgtttcgctcgccgctactaaggcaatcgcttttgctttctcttcctgcagctacttagatgtttcagttcactgcgtcttcctcctcacatccttaacagatgtgggtaacaggtagtacctgttgggttcccccattcggaaatccctggatcatcgcttacttacagctacccaaggcatatcgtcgtttgtcacgtccttcttcggctcctagtgccaaggcatccaccgtgcgcccttattaacttaaccttattttttgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatcmwtagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaaaatctatctctagagcggtcagaggga

SEQ ID NO: 68 - DNA, 75285 bp, Streptococcus mitis NCTC 12261 contig14
aacagcagaccgcgtcaagaacgctaaaaaactcatggataccgaaagttaccaagactatatgaaacgtgtacatggataaaaaagaagcctgatggaaacatcgggcttttgatmctcaatgaaaatcaaagagcaaactaggaagctagtcgcaggctgctcaaaacatggttttgaggttgtggatagaactgacgaagtcagctcaaaacactgttttgaggttgtagataagactgacgaagtcagtaacacatctacggcaaggcgaagctgacgtggtttgaagagattttcgaagagtatgacttgcaaaaagacttagcaaaccagctaagcctttttcttcttatctcgaacgttgttttccagcgttgcgatttttgtgttttttcttgcttgtgatagcagttggttgttcaggggtaacgtcttttcgtccacttggtgtagagaaagcacgtgcttttggtgggttcttggctagttcttcacggacttttttgcgaagttttggacggacgatatagttgacgataaactgttggagaatcatcatgaaaccaccgacaacccagtaaagtgtgacactggctggtgaaatgagggagaagacaacaatcgtgattgggctcacgtaagccattttcttgatttgttctctttgcgtttcgtcttctactccgtgaagtgaaaggagcgattgaagatagtaaaggacacctgcgcaggcaaccaaaatcatacttggagaacctagaggaatgcctaggtagcttgcttgagcaaccccttcagtatgttgggcagcaaagtagatagctgagaagaaaggcatttgaaggaggatagggaagcatcctacaccaccaaacatgctgatgccgtgctctttttgagcagcaaagagagcttgttgggcttcgagtttttcttcttgagtagtcgcttccttgagacgtgtttggtgtggctcaaggacgtgcttgagggcgttcatcttttcagagtgaagcgttgccttccatgattggtagataccaagtggcaagataatcaagcgcacgataatggttacgataatgatagccataccaaagcctagaccttgatcagtagcgaagtacttgatagcttcagccataggcgctccgaaagtattccaaataaatcctgttggctctcctgttgctttatcgacgctaacacagccagtcaagacaagcaacatagccactcccatagtcgagagtgcaaaacgtttaatagatttcactgtttttattccttctttaaaaattatacctttctattctactgtttttttacaaaatatacaatagttctagagacttaatttgcgattttaaagtcagggtagggaggaaagttacttagtttgacatctaagtagctgacttttgaaaaaggtgtgggtcctttgcggatttcttggataaattttgccatggtagcagatgagtctgcttgggctaatatttccactgtgccatcgtcgttattccatactcgacctgtgatgccaccaatttcaagcgccaagctgtaaacaccccaacgaaaaccgactccctgcaccctgccttgggcgatcattctaaccttttgcataccaaactcctttgattgtgttataatatttctatgactattataacctcaaaagccaattctgtggtaaaaaatgccaagaaattacaccaaaaaaaataccgcaagtctgcttatttgattgaaggctggcacttgtttgaagaagctgttcaagctggagtgacgattgagaaaatctttgccctagaaagttatcgagaacagttagctgctttttcgcaaactgtctgggtgtcagaggatattttgctagatttggcggattctcagactccacagggaattgttgccgtggttcaaaaagaagaagtagggcaagctgactttagccagggcaagttcttgtttttggaagatgtgcaagatcctggtaatgtgggaactatcattcggactgcggatgcagcaggttttactggagtgattgtttcagataaatcggcagatatatacagtctcaagactctacgttccatgcaaggcagtcatttccacctgcccatttataggatgtcgagtcaagcgcttcttaaggaaaccaaagaggcaggtatctcagtgctggcaacaaccctatctaaagattctgttgattacagagaactgcctcctatagaaaattttgtactagtcatgggaaatgagggtcaaggaattagttccctcatggctgaaagtgcagatcaattggtccatattagcatgaaggggaaggcagagagtttgaatgttgcagttgcggccggtattttaattttccatttaagctaattttaactttctttgttataatcaaggaaagatgttcatagaaaaggagaaaagatgaatcacactattattcacgaccgcgcaggtctcaatcaattttacgctaaggtttatgcctttgttggtctgggaatcggattatccgctttagtatcaggtcttatgttgacggtctttcaatctcagttggtttactttttgatgcagggacgcctctggttgaccattgctacttttgcggagttggccttggttttcgttgccagtaacatggccttaaagaatagtccagcggctcttccagtatttttactttactctgttttaaacggctttactcttagttttgtggtggccttctatactccgggtacagttttatccgcctttgtgtctagcgcccttctcttctttgtcatggcggcagttggcatgttcaccaagaaagatttgagtggccttggtcgggctatgatggcggctcttatcggtttgctgattgccatggtagttaatattttcttggctagcggcttctttgattatatgattagcgtagccatggttttggttttctcagggttgattgcttgggacaaccaaagaattcgtcttgcttatgaacaatcacaaggccgtgtagcgacaggttgggttgtgtcaatggctctcagtatctatcttgattttatcaatctcttcctaagtattctacgtatcttcggtcgaaatgactaaaaggttcatgacatcagtgttcgaaggagcactgatttttttatatttggtcttttcttttcttggaaataggtgtataatgcttttaattaattttttgaggagtagtttatgaagaaaagttttattcatcaacaagaagagatttcctttgtcaaaaacacttttacccagtatttgaaagataagttagaagttgtcgaagttcaaggtcctatcttgagcagggtcggcgacgggatgcaggataatttatcaggtgtggagaatgccgtatcggtcaaggttctccaaatccctgatgctacttatgaagtggtgcactcacttgccaaatggaaacgccatactttggcccgttttggtttcggtgagggagaaggcctttttgtccacatgaaggcccttcgtccagacgaagattcgctggatgcgacccactctgtttatgttgaccagtgggactgggagaaagttatcccaaatggtaaacgtaatatcgcttatctaaaagaaacagttgagaagatttacaaggctattcgtcttactgagctagctgttgaagcccgctatgacatcgaatcaatcttgccaaaacaaatcacttttatccacacagaagagttggtagaacgctacccagatttgacaccaaaagagcgtgaaaatgctatttgtaaagaatttggagcagtattgcttgatcggtatcggtggtgaattaccagacggtaaaccgcacgatggacgtgcaccagactacgatgactggacaagtgagtctgaaaatggttacaagggtctaaatggtgatattcttgtttggaatgagtctctggggggagcctttgagttgtcttctatgggaatccgtgtagatgaagaaacgcttcgtcgtcaggttgccattacaggtgatgaagaccgcttggaattggaatggcacaaggctttgttgaaatggtctattcccattgacaatcggtggaggaattggacaatctcgtatggccatgttcttacttcgcaagaaacacatcggagaagtgcaaacaagtgtttggcctcaagaagtccgcgatacttacgaaaatattttgtagagaatcgaaccgcaaggttcggttttctttctcttttcgcccataatttggtataataaacggtatgaaaatcgtatcaggaatctatgggggacgtcccctcaagacactagaaggaaagacgacaagacctacttcggataaggttaggggagccatttttaacatgattggtccctactttgaagggggacgagtcttggacctgtatgcaggtagtggtggtttatctatcgaggcagtctcgcgtggcatgtccagcgctgttttggtggaacgagaccgtaaggctcaggctatcgtggctgaaaatattcagatgaccaaggaagttggaaaatttgagctcctcaagatggatgcagaaagggcattggaacaggtatctggggaatttgacctcattttcttagaccctccttatgccaaggaacaaatcgtagcagatattgaaaaaatggatgagaaagagcttttttctgaagatgtcatggtcgtgtgtgagacggataaggccgtcgaacttccagaagaaattgcctgcctgggtatctggaaggaaaaaatttatggaattagtaaggtgacagtttatgtcagataagattggcttattcacaggctcatttgatccgatgacaaatgggcatctggatatgattgaacgggcgagcagactctttgataagctctatgtcggtattttttttaatccccataaacaaggatttctccctatcgaaaatcgtaaacgggggctagaaacggctttgaaacatttggaaaatgttgaagttgtgtcttctcatgatgaattggtggttgatgttgcaaaaagactgggggctactttcctagtgcgaggcttgagaaatgcgttggatttgcaatatgaagccagttttgattactacaatcatcagctgtctcctgatatagagaccatttatttacatagcagacctgaacatctctatatcagttcatcaggtgttagggaactattgaagttcggtcaggatattgccggctatgttcctgatagtattttggaggaaataagaaatgaaaaaaaagattagatggcccttatatgtcattgcggccttgattgtgactttcttggcatttgtagtgcccttgccttattatatagaggttccaggtggttcggaagatattcgccaagttcttaaagtaaatgacacagaagataaggaagctggggcctatcaattcgttacggttggtgtccagcacgctactttagcccatatgatttatgcttggttgacgccttttacagatattcgtagtgcccaagagactacaggtggctcttccgatgttgaatttattcggatcaatcaattctacatgcaaacatcacaaaacatggccaagtatcaagggttaaaaacagctggtaaggatattgaactcaaatatcttggggtttatgttttgactgtgacagataattcaacctttaaagggattctcaacatctctgatacggtcacagcagtcaatgatcagaccttcgacagttccaaagatttgattgattatgtcaattctcaaaaattaggggactccgtcaaggtcacctatgaagaggatgggcaaaccaagtctgcagaaggaaaaattattactctagaaaatggcaaaaatgggattggaatcggtttgattgaccgtacggaagtgaccagtgatgtcccaattcgcttttcaacagctggtatcggcggaccaagtgctggtctcatgtttagtctggccatctatacccaaatagctgaccctggccttagaaatggccgtatcgttgccggtacaggtaccattgaccgcgatggtaatgtgggggacattggaggtattgataagaaagttgtagcttcagctagagaaggtgccgcgattttctttgcacctgataatcctgttagcgaagaagaaaagacagcacatcctgatgctaaaaacaactaccaaacagccctagaagcagctaaaacaatcaagacggatatgaaaatcgtgcctgttaaaaccctacaagatgcaattgattacttgaaaaacaatccctagttttaagttaagtttccaaactagcgcacaaacagagaagatggtataatagtcaaatggttcaattattattcactctaagcagtcacatgctctttatttatgtgagtttttaccttttaaagaatcttgttagatgggaaaaggttttaaaagtgacagctgagaatacaggaaaagttcgtttactagtagcctttttcagcattgtaatgggctatatcatgagttctttctttatcagcctatatcagttgtggcaagaagcgcttagaggattattataaaatcaaatgtaaaggaaataagtatggaaaaaattgtggttcaaggtggcgataatcgtctggtaggaagtgttacgattgaaggagcaaagaatgcagtcttacctttgttggcagcgactattctagcaagtgaagggaagaccgtcttgcagaatgttcctatcttgtcagatgttttcactatgaatcaggtggttctcggtttaaatgccaaggtggattttgatgaggaagctcatcttgtcgaggtggatgcgactggcgatatcacagaggaagctccttacaagtatgtcagcaagatgcgtgcatctatcgttgtcttgggaccaattcttgcccgtgtaggtcatgccaaggtatccatgccaggtggttgtacgattggtagccgccctattgatcttcatttaaaaggtctggaagctatgggggctaagattagtcaaacagctggttacatcgaagccaaggctgatcgcttacatggagctcatatctatatggatttcccaagtgttggtgctactcagaacttgatgatggcagcgactctggctgatggggtgacagtgattgaaaatgctgcgcgtgagcctgagattgtggacctagccattctcctcaatgaaatgggagctaaggttaagggggctggtacagagaccattaccattacaggtgttgagaaacttcatggtacgactcacaatgtagtccaagaccgtatcgaagccggaacctttatggtagctgctgccatgactggtggtgatgtcttgattaaagacgctgtctgggagcacaaccgtcccttgattgccaagttacttgaaatgggagtggaagtgacagaggaggctgaaggaattcgagttcgctctcaactagaaaatttaaaagctgttcatgtgaaaaccttgccccacccaggatttccaacagatatgcaggcccaatttacagccttgatgaccgttgcaaaaggggaatcaactatggtggagacagttttcgaaaatcgtttccaacatctagaagaaatgcgtcgcatgggcttgcactctgagattatccgtgatacagctcgtattgttggtggtcaacctttgcagggggcagaagttctttcaactgaccttcgtgccagtgctgccttgattttgacaggtttggtggcacaaggaaaaactgtagttggtaaattggttcacttggatagaggttactaccgtttccatgagaagttggcacagctaggtgctaagattcagcggattgaggcaagtgatgaagatgaataagaaatcaagctacgtaatcaagcgtttacttctagtcattttggtactgtttttaggtgctctagccctaggtatcggcttaatggtaggttatggaatcttgggcaagggtcaagatccatgggctatcctgtctccagcaaaatggcaggaattgattcataaatttacaggaaattaggctggagaaccagtctttttctagagataaggagaaaaatggataaaaaaacaagacagacactgatcggactgctagtgttattgcttttatctgcgggaagctattatatcaagcagatgcagtcgacagctaatagtcctaaaacaaaggttagtcagaaaaaacaagcgtcggaagctcctagtcaagaattggcagaaagtgtcttaacagacgcagtcaagagtcaaataaaagggagtctggagtggaatggctcaggtgcttttatcgtcaatggtaataaaacaaatctagatgccaaggttcaagtaagccctacgctgataataaaacaaagacagtgggaaaggaaacagtgccaaccgtagcaaatgccctcttgtctaaggctactcgtcagtacaagaatcgtgaagaaactgggaatggttcgacttcatggactcctccaggctggcatcaggttaagaatctaaagggtacttatacccatgcggtcgatagaggtcacttgttaggctatgccttaatcggtggcttggatggttttgatgcctcgacaagcaatcctaaaaacattgctgttcaaacagcctgggcaaatcaggctcaagccgaggattcgactggtcaaaactactatgaaagcatggtacgtaaggccttggataaaaacaagcgtgttcgttaccgtgtaactctttattatgcttcaaacgaggatttagttccttcagcttcacagattgaagccaagtcttcagacggagaattggaatttaatgttctagttcccaatgttcaaaaagggcttcaactggattaccgaactggagaagtgactgttactcagtaaaatacaaaataaactcctatgtcacttgtggatataggagttctttcttactagtttaagcagggctacaatagacactgatactcaatgaaaatcaaagtgcaaactaggaagctagccgcaggttactcaaagcacagttttgaggttgcagataaagctgacgtggtttgaagagattttcgaagagtatgggaaaaataatatgtactggactatattttgtgatataataaaggataagatactattttaggagaagaactatggaagacccaagtagtcagaatttgttgctacaatttgttttattgtttatcttgacggtgttaaatgcctttttctcagccacagaaatggccatggtttcacttaaccgtgcgcgggttgaacaaaaggcagaagaaggagatagacgctatatccgtctgctgaaggtactagaaaatcctaaccactttttatcaactattcaagtaggaattaccttgattacgatcttgtcaggggcaagtttggcagaaactctgggacgagaaattgcatcttggcttggaaatggcgaaacagcttatgctattgcaagttttctatctttagcatttttgacttatatttctatcgtttttggggaattgtatcctaagagaatcgctcttaacctaaaggacgctttagcgattcgtacagcgccagttattattggtctggggaaactagttagtccttttgtctggctcttgtctgcgtctaccaatcttttgagtcgtttgactcctatgacctttgatgatgctgacgaaaaaatgacccgtgatgaaattgagtacatgctgacaaatagtgaagaaacactagatgctgacgaaattgagatgttacaagggattttttcactagatgaactgatggccagagaagtcatggttcctcgaacggatgcctttatggtcgatattcaggatgatagtcaaaccattatccaaagcattttaaaacaaaacttctcccgtataccagtttatgatggggataaagacaatgtgattggaatcattcataccaagagtctccttaaggcaggctttgtggacggttttgacaatattgtttggaagaaaatcttacaagatccactttttgttcctgaaactatttttgtggatgacttgttaaaagaattgcgcaatacccaaagacaaatggcaatcttgctggatgaatacggtgggatggctggtttggtgaccctggaagacctcttagaggaaatcgttggggaaatcgatgacgaaacagataaggctgaaatcgaagttcataaaattggagaagatacttatatcgttcaaggcaccatgaatctcaatgattttaatgactactttgatgttgaactggaaagtgatgatgttgataccatcgctggttactatttgacaggagtggggaccattccaacgactgagaaactcagttatgaattagtcagccaaaacaaacagcttatcctaaccaatgataaagtgaaaaatggacgtgttaccaaggtaaaagtccaaattaccgaagttgaaatagaagaagaaacagagtaaactagaggcttttgtcaccaggcgtgacgaagcttttttcagttgatttcaagagggaattgtgtcctcgaaaaactcagccccaacctagtctcaaaagttttttaaggttatacgtatttattcgaggaaaaaagaaaaaagccctttaaattgggctttctgtttaaatgaaacctgaaaaaatcaagttatagaaggcggtagacggatttgaaccgacgatcaagcttttgcagagccgtgccttaccacttggctataccgccttaacgtttattattataccttgaaaatgattttcagtcaatagctttttcagattttttgtgtcaataagcctaaatattctgaaaattcgtttacttttcttgaaatctatgatataattgatgataacctatactttatttataagaggagtaaataaatgaaaaaaagtcaagtgcttgctgtagcgggagctaccttattagcgtcaggagttctagctgcgtgttcaaacactagttcaaataatgctaaactagcaaaagattaccaatatgtctatcaaacagatccagaaactttggattatatcgtcagcaatatcgattcaacatcattcgtcacaacaaatgctgtagatggtttgttggctaatgataaatatggtaacttggttccttctattgctgaatcatggacagtttcaaaagatggtttgacatatacctataaaatccgtaaggatgctaaatgggtgacagcagagggagaggaatacgctcctgtaactgctaaagacttcgttactggtttgaaacacgccgtagatggaaaatcaaaaggactttcaatcgttagctcttctattaagggattagaagcctatatcaagggtgaaacaagcgatttttcaaccgttggagtaaaagcacttgatgatcaaacactagaatataccttgaaccagccagaaactttctggaatgacaagaccactagtggtgttttgatgccggttaatgaagaattcttaacttcaaaaggggaaggttttggtgccccaaccgatgctaactctattctttataacggtccatttgtcttaaaatctgtaactccaaaatcatctatcgagatggctaaaaatgatgcttactgggacaaagaaaatgtaaaaattgagaacgttaagttcactttctgggatggtaaggaccaagatgtgattgccaaaggttttgctgatggtcaatatagcaaggctcgtatcttccctacaagttctacatatgaaaaatatgcagctgactttaaagataacatttactttaatgaaccaggagcgggtgttgcaactgtcagcttgaactatggccgtacaacctataatcatactgccaaaacaagtgatgctcaaaagacatctactcagaaagcattgctaaacaaggaattccgtcaagccttgaactttgctgtcgatcgcaattcttactcagctcaaacaaatggtactgatggagctgcagtagccatccgtaatacattcgcaccatataatcttcaagttggtaagaaaacatttggtgaattggtacaagatagcttggctaagacaaattcttctacttggtcaaacgtgtctctagcagattctcaaaatggcctttacaatgaagaaaaagcgaaagaagtctttgctaaagccaaatcaagtctacaagctgaaggtgttgaattcccaatccacttggatgccctggttatccaagaatcaacagcggttgtaaaccgtgttcaatcattgaaacaatcaattgaaaaagtattgggttcagataatgttgttgtagacttacaacaaatgactcaagcagaagctttaccaatttcatttagcgctccaacagctaaagagcaagactgggatatccataccttgctaggatggaacccggactatcaagatccttctactttcttggatcaattcgtccttaagggaggaagcactcgcctttaccttggtattgaccaaaacacagatgcatcagtagtaagcaaacttggtttagctgactatggaaaattacttgatgacgcaaacagcgaaaaccaagatgttcaaaaacgttatgaaaaatacgcggtggcacaagcttggttgactgacaatgctttgacaattccagtaatggcttctcctaaagaaacagccgtttcatatgtttcaaaagttctaccatttagctcttcatattctgtagccggccttaaaggtgaaaattcaggatacttgaagtacactgaagttggtgaaaaagcaatcaccaaagaagagtatgaaaaagctcgtgaaaaatggttgaaagaaaagactgagtcaaacgaaaaagctcaaaaagaattggcaagtcatgtgaagtaaataattttcaatagaactttctctccatgaggagaaggttcttttgggatttttaaaggaaatgatatgaaaaaatatatttttatgcgtgttttgcggtccttggtttctatcttcttagtaacaaccttgacttacacgattatctatacaatggttcctcgaaaattgattttcaaacaggataccaactataacaagattgctacaactgctgataaacgtgataactatgagaataccgtttatgagcgtatgggctatatcgagtactacgataccaaagagttgcaagaaaaagctagccagatggatgcttctgtaacagttgaagccaatgataccaacaaggctatctatgaaaaatacatcaaacaaatcggtcatggttggaccctgggagaatttactgaaagtggccaattctacgctacgcgtgaaatcccgatttttgaacgtgtttttcacttctatgctaacttgattgacattgatcatacaaataaaattcaagaccctgaaaatccagacttgaaacgttaccttcgttttgaaaacgatccagcgatcggatggtccttggtcggttcaggaacaaaacacaaatatctcttgtacttcaacagtcagttcccgtttgtgcatcaaaactttgtgaacattaatttaggtgactcttatccaacctatgctaatagccctgttttacaggtcattactcaaggacaagggcaaacaaaaacatctcaagttcagttcccaacaggtaagaaaacttcttctgtaaatatttactcaagaacctacaaatcgcctagtcaggctgattctcgtgaagtagccaactatgggaaagatgacccatatactgcaactgaaagcaactaccaatatccttctatgattgctagctctgcagtcgttggattgattggtttggtgatttcttatgcgattgccgtgccacttggttcagctatggctcgcttcaagaatacttggattgatagcttctcaacagggtttttgaccttcttgatggcccttccaaccattgccttggtttacattgttcgtttgattggatcatcaattggtcttccagattcattccctattttgggtgctggagattggcgttcgtatgttttaccagcagtgattcttggtttgttgggtgctcctggtacagctatttggattcgtcgttacatgattgacttgcaatcacaggactttgttcgttttgctcgtgccaaaggtttgtctgaaaaagaaatttcaaacaaacacatctttaaaaatgccatggttccgctggtttcaggaattcctggtgccgttatcggggttattggtggtgcaacccttactgaaacagtcttcgccttcccaggtatgggtaaaatgttgattgactctgtaaaagcatctaataactctatggtcgttggtcttgtcttcatctttacatgtatttctatcttctcacttcttttgggagatatttggatgactattattgacccacgtattaaattgactgagaaaggaggcaaataatgtctacaatcgataaagaaaaatttcagtttgtaaaacgtgacgattttgcctctgaagctattgatgcgccagcttattcatactggggttcagtgtttagacaatttatgaagaagaaatcaactgtagtcatgttgggaatcttggtagctatcattttgatgagtttcatctacccaatgttttctaagtttgatttcaatgatgtcagcaaggtaaacgactttagtgctcgttatatcaagccaaatgctgagcattggttcggtacagacagtaacggtaaatctctttttgacggtgtctggttcggagctcgtaactctatcctcatttctgtgattgcgacagtaattaacttggttatcggtgtttttgtcggtggtatttggggaatttcaaaatcagttgaccgcgtgatgatggaagtttataacgtcatctcaaacatcccatctcttttgattgtcattgtcttgacttactcaatcggagctggattctggaatctgatttttgccatgagtgtgacgacatggattgggattgccttcatgatccgtgtgcaaatcttgcgttatcgtgacttggaatacaacttggcgtcacgtactctgggaacaccaaccttgaagattgttgccaaaaatatcatgcctcaattggtatctgttattgtgacaaccatgactcaaatgcttccaagctttatctcatacgaagccttcttgtcattcttcggtcttggattaccaattaccgtgccaagtttgggtcgtttgatttcggattattcacaaaacgtaacaaccaatgcttacttgttctggattccattgacaactcttgtcttggtatccttatcccttttcgtagttggtcaaaacttagcggatgctagtgatccacgtacacatagataggagtagaaatgacaaaagaaaaaaatgtaattttgactgctcgcgatattgtcgtggaatttgacgttcgtgacaaagtattgacagccattcgcggcgtttcccttgaactagttgaaggagaagtattagccttggtaggtgagtcaggatcagggaaatctgttttgacaaagacattcacaggtatgcttgaagaaaacggtcgcattgcccaaggtagtattgactaccgtggtcaagatttgacagctttatcttctcacaaggattgggaacaaattcgtggcgctaagattgcgactatcttccaagatccaatgactagtttggacccaattaaaacaattggtagtcagattacagaagttattgtaaaacaccaaggaaaaacagctaaagaagcgaaagaattggccattgactacatgaataaggttgggattccagatgcagatagacgttttgatgaatacccattccaatattctggaggaatgcgtcaacgtatcgttattgcgattgctcttgcctgccgacctgatgtcttgatttgtgatgagccaacgactgccttggatgtgaccatccaagctcagattattgatttgttgaaatctttacaaaacgagtaccatttcacaacaatctttatcacccacgaccttggtgtggtggcaagtattgcagataaggtagcggttatgtatgcaggagaaatcgttgagtatggaactgttgaggaagtcttctatgaccctcgccatccatatacatggagtctcttgtctagcttgcctcagcttgctgatgataaaggggatctttactcaatcccaggaacacctccgtcactttatactgacctgaaaggtgatgcctttgccttgcgttctgactatgcaatgcagattgacttcgaacaaaaagctcctcaattctcagtatcagagacacattgggctaaaacttggctacttcatgaggatgctccaaaagtagaaaaaccagctgtgattgcaaatctccatgataagattcgtgaaaaaatgggatttgcccatctggctgactaggaggaaggaaatgtctgaaaaattagtagaaatcaaagatttagaaatttccttcggtgaaggaagtaagaagtttgtcgcagttaaaaatgctaacttctttatcaacaagggagaaactttctcgcttgtaggtgagtcaggtagtgggaaaacaactattggtcgtgccatcatcggtcttaatgatacaagtaatggggatatcatttttgatggtcaaaagattaatggtaagaaatcgcgtgaacaagctgcagaattgattcgtcgtatccagatgatttttcaagatcctgccgcaagtttgaatgaacgtgcgactgttgattatattatttctgaaggtctttacaatcatcatctgttcaaggatgaagaagaacgtaaagagaaagttaaaaatattatccgtgaagtggggcttcttgctgagcacttgactcgttaccctcatgaattctcaggtggtcaacgtcaacgtatcggtattgcccgtgccttggtcatgcaaccagactttgttattgcggatgagcccatttcagccttggacgtttctgtgcgtgctcaagtcttgaacttgctcaaaaaattccaaaaagaacttggtttgacctatctcttcatcgcccatgacttgtctgtcgttcgctttatttcagatcgtatcgcagttatttacaagggtgttattgtagaggttgcagaaacagaagaattgtttaacaatccaattcacccatatactcaagccttgctttcagcggtaccaatcccagatccaatcttggaacgtaagaaggtcttgaaagtttacgacccaagtcaacacgactatgagactgataagccatctatggtagaaatccgtccaggtcactatgtttgggctaaccaagccgaattggcgcgttaccaacaagggttaaattaataatggttttataatttccatgtcaacttttatggaaattataaaccttttttgttggactgatttgaaaaaactttgaaagaattttcgaaagaaatagaattcttagaaaatcattgaattatagtgagatgaaataaaatctgaacaactcgattaggaaagtcaaattaatttctagaaaaggtttagaagtcgcggcgtattactctagcttcaatctactatagtctaatactcttcgaaaatctcttcaaaccacgtcagctctatctgccacctcaaaacagtgttttgagcaacctgcggctagcttcctagtttgctttttgattttcattgagtctaatatctacaatgtaaaaaactctagctatcagttcattgatagttagagttttttctattcatatgatttaaggagtttaaataaagcttctatttctgatgacggtgtagctgatttaaggtaagcgtaataaactgtaaaagttatcttatccttcggtataagaggaatttttattaaatcgtcatcttcatcagaaagtgcgatatcagccagtaaactaaggccaattcctttctttaaaagttctttaagaatgacaatgtcatcagtcttaaagaatatttctgccttgttttgatgcttttgattaagcgtttcaaaagctttcaggtgaacaaagtgttcgtctaagagtataaaggattgatctactaattcttcaaaagcgagggaaggagcagtggcaaaaggatggttcttagataaaacgacatacagttctttatgaaatagctcgtgtgtctctattgaaggataattgagaggttcaatcaaaccgagtaggcttacattaaggtctcccttaaggagaaggtttaataactctacggaaccaccgcggataggacgtatcttttttaaaaaatcgaatttatctttttcgtttaaggcagcaaagagatactgaatgataataggagggaatcctacagtagagtattgtgccaaggagcgattaatttctttgcgagtagaaatgaactcaggtaaaatcagttctgtatgctttagaaggatttgtccttgaggagttagcttgaaggaacgatgcgaggggtcatggtgaatcaatttgcagttaaagtattcctctaagcgcttgatagcataagaaatagatggttggctgactttatgttgttttgctacttccgtataggattgaagctggcagaggtcataaaaatattgtagatcttttaaattcatatgggttcactttcattagttggagaaggaaaataagtggaaaacagcagataaataatttttatccgtatcctacaatttgactatacgagtattcaccagttaaaatgtaagtgagtcagggatctcaaagattatctaagatactctcaaaaatgaccaacattttttctcgtttatcaatagggagctgtttaatcttcatgttgattcttttgagtgaaagattgtcactcttatcagaggttgattcaaggctatcaaaattgaaaaattcctctggggttatttctagggcgtcaatcactttttcaagactgtgaatggtcagattcacattttggttttcaagttgattgatatacttaagcccgaggcctgcttgttctgaaagttcttcctggctcattttattctgtgttcgaaaatatttcactttttgggaaatatattgttgtaaatagtttttagttgtcatataaatagaatacaagttttatatgacaaaaaaacaccttaaaaaatacaaagtattacataacatacctatatgatatttattttaattaggattgtcaatttgtatgattggtttattttactcgaaacttttagtaaagagagatcatcgagagtttgatgagttcagaaatttataacatatgcgtatacaattgtattatttaaacaacaacgttttacgaacaattcgtttcatgtggtataatataagtaaaaaggaggttgcactatgacttcacatgatattttaaacaatcctttactcaataaaggtactgcctttaccttagaggagcgaaaggaactaggccttattggtttattgccaccgtatgttcaaacgattgaagaacaagcggcgcaaacttatgcacaaatgcaaacaaaagccaatgatttggaaaaacgtctttttctaatggaaatttttaataccaacaggactcttttctattaccttttttctcaacatttggaagaattcaatccaattgtatatgatccaactattgcagatacgattgaaggctatagtgatctttttgtagatccccaatatgcgggatatcttgatattaatcatcctgaaaatattgaagctactttgaaaaacgctgccgggggtcgcgagattcgtctcattgttgtaacagatgcagaaggaatccttggaattggcgactggggaacaaatggtgtcgatatttctgttgggaaattgatggtctatacgggtgctgctggaatcgatccttcgatggtccttcctttagtcattgatgcagggactaaccgtgaagaacttcgtaacaatcctaattacttaggaaatcgtcacgaacgggtctgcggagatcgttactacgacttcattgaccaatttgttcaaacagcagaacgtctctttcctaaactctaccttcactgggaagacttcggccgcttgaatgcagccaatattcttgaaaaataccggaaacaaattccgacctttaatgatgatattcaaggtacaggaatcgttaccttgggtggtatctttggttcgctggatattagtggtgaaaaattaatagatcaagtttatctttgctatggtggtggtactgcgggtgcaggaattgcctctcgtgttcttcgtgaaatggtaagtgaaggtctttctgaagaagaagcctataaacggttctttatggttgataaacaaggtcttctctttgatgacatggatgacttgacaccagagcaaaaaccatttgctaagaaacgtgctgactttagtaacgcagataagttgactgacctgcttgaagtagtgaagactgtgaagccaaccattcttgtaggaacttcaactcagcctaataccttcactaaagaaatagtagaagctatgtgtgaaaacacagaacatccaatgatcttccctttgtcaaacccaactaaattggcagaagctagtgccaaagatttgattgaatggtcagatggtaaagcttttgtcgcaacaggaattcctgctgatacggtttcttataaaggtgtagactatgtgattggtcaagcaaataatgccctgatttacccaggtcttggtctaggtatgctggcttctgaagcaagtcttttgactgatgaaatgattggagcagcggcgcattcattgagtggtattgtcaatccaggccaaccaggagctcctgtcttgccaccattcaagtatgtagcagatgtttctattaaagtagcagaagcagtcgctaaaaaagcacaagagcaaggtcttgcacgcgctaaggaaacagatatggccaaagcagttcgtgatttgaagtggtatccagagtataaataattcatttctgttgcctatcctcgggatacttggcttattttggatatgttagcaatctacagagttgataaccgaaaagtaaagagattgtcgtattgactattggttttaaacagtataaaataactgtcgattttttgtccgactgcaagagttagtttaatactatactaaaatcaaaacgcattatataatagtgatatgaaatcaaccaaaaaagaaatacaagccatcaaaacacttttaaaaaactctagtacaactaaataccataaaagtcttcaaatcgttctattttgtctaatgggcaaatctttgaaattatcctaaaagaattgaaagaattatgaaagaattttcgaaaaattttaaaaaattctgaaatattcttgacaggtgatgaaaaaggtggtaagataggaaacatcaaaaaagaaagcagaaaaagaaatgaacaagaaacaagctgtaacgatgaatcaaaacttttactttagctactttagatagtgtttgtagacatgtcaccatggatgcaaacagttcaagcaatttgtttgtatctatgtggctaagatttttgattgtggtccatatagatgaatatctaaatggactagcaaagttataacttgttagattatttcaagcatccgtttaggtattatctaggcggttttttgttttatactcttcgaaaatcaaattcaaaccacgtcaacgtcgccttgccgtactcaagtacagcctgcggctagtttcctagtttgctctttgattttcattgagtattatcttttctgagaaggagtttcattatgaaagttgttcgaaaattactagcacccctcttggtagtggggattctcttgacctctctgatcagtttgcatcagttgaaggcagataagaaaaaagatgtatttcgtatcggtatttcacaatttattacccaccagtctctagacgctaccagagaaggctttgtggatgagctggccaagcaaggctatgttgaagggaaaaatatcgagattgatttgcaaaatgcacagggagaacaacgaaatcttaaaacgatttcccagcaactagcagaatctagtgatgtcgttctagctattgcaacgccttctgctcagagcttggccaatacaacacaaacgacacctgttatcttttcagcggtaacagatcctgtcagttccaagttggttgagtcaagagagcatcctgggggcaatgtgactgggacaagtgaccagtcatcagatgccatttcaacccaaatcaatttgataaagaaagtgttgccaaaagctaaaacaattggaattctttatactcagagcgagccaaactcagttgtccaaaaggatgaagctaagcgtcttctggaagaaaaaggctttaccgttgttgaaaaaacaatcttggacagtaacaacgtcaaggcggcagcagagagtttgatggcagaggtggatatggtttttgtcccaacggataatatcatttcgtcaaccatggaaacagttaagcaggtttctattaaacacaaggttccagtattcggtggttcaacagaaatgattgctgttggtggcttgtataactacggaaccaattatgaagaattaggaagacagacagctcgcatgttgattcgtgtcttaaaaggtgagaagccagaaaatatagcagttgagttgcctgaaaaactggaattgcataccaatcaagaaatggcagatgcattgggaattgatattagtaagttagaaggcaaggaataaggaggtttgagatgaattttgtattatctagtttatcagaaggtttgctatggtcgattatggctattggggtctacttgactttccgtattttggatattgcagatatgactgctgaaggagcctttcctctgggggcagcagtcgttgtatctcagatacaggcagggacaaatccttggattgcgaccttacttgctttgctggcaggtatggtagcaggtcttgtatcaggaatgcttcacaccaagatgaaaattccagctctcttgacagggattgtgaccttgacagggctttattccatcaatattaaaatcatgggaagtgtgcccaatctttccttgggagattcttcgactgtctttaaacagttggcgagcttaggactgacaaatgaagaagctgttttctcattcagtttggcctgtctcttacttgtttgtttggtcttgactcttttgatgaaaacagagattggcttggtcttgcgttcgactggggacaatattccgatgagtgaggccaatggggtcaatgtagacaccatgaagattgttggttacatgatttcaaacggcttgattgccctatgtggttctttgtttgcccaaaatgatggattttcagatgtgacttctgggacaggaaccattgttgttggtttgagtgcagtgattattgcggaagtcttgatccacgatttgaccattggaggccgtttgttatccatcggaattggtgcaattgtttaccgtttgattattttaaatatctatgaaattccaaatctagatcaaaacctggttcgtctctttaatgcaatcttgttagccttagttttatttgcaccagaattgcaaaagagattaaagattcgtggtctgaaattgagaaatgaataggaggagaaagttatggcaagtttgttaacacttgaaaatattcacaaaacatttgaagcagggacggtcaatgagaaccatgtcctcaaagggttagatttagaggttgaagagggagattttatctctgtgatcggtggaaatggagcagggaaatccactttgatgaatatcttggctggcaatctatcggtggacgaaggggaccttttattggcaggcaaatccattaaaaatctgagtgtaagaaagagagccaaggatatcgcccgtgtttttcaagatcctaagatgggaacagcttctcgtttgacgattgaggagaatatggctattgccttgagacgcgggcagaagagagggcttggttggggcgtgaaggagaaggatagaatccagttccaagaggccttgaaggagttgaatattggtcttgaaagccgcttaaaagtagatactcaatacctctcaggaggacaaagacaggctttgaccctagtcatggcagctctggtgaaacccaaactcttgcttttggatgaacatactgcggcacttgacccgaaaacgagtcaaatggtgatggatttgacgcaaaagattgtggaacaccatcagttgacgactttgatgattacccacgatatgaaccatgcgattgagtacggcaatcgtctcattatgctctatcagggtaagatagtggtggatgtcaagggagaggagaaaaagcatctgacggttgaagatctcatgcatctcttccagaaaaatagtggccaaagtctagttagtgatgaattagttttgggataaagaaaaaggctgagatgtggtgtctcagtcttttattagtacaaatggataggcagaaatatgaaattgatactcttcgaaaatctcttcaaaccgtgtcaactctatctgcaacctccaaaccgtgttttgagcagcctgtggctagcttcctagtttgctctttgattttcagtgagtataaactcagtagggagctctcttttgcagaaaagcagggttctttttgctgtctattccctccctgaaagcgtaaaacaaactagtcagggtggctagtttgtggtataatgaaagagactcaaaaagaaacaggagaaaaatgatggatttactattagcaattgtattgattgtgctagcttttctaggaggagctcttggagggatgtacttggttcgtaagcaaattgaaaaagaattcgctgacaacccacgtttgaatgctgaagcagttcgtactcttttgagtgcaaatggtcaaaaaccaagcgaagctaaggtacaacaagtttaccaccaaatcatccgccaacaaaaggcagcccttgctaacaataaaaagaaaaaataaataaggaaaagtctgggatgaaagttccagacttctcactatgttggttatggtttaggaatgcgactttttccttgcattctattgatatttgattatgattaagagagatagttgttgattaggatgtcattcagttcataaggatcaataatcataatgaactatcaatcagaaaaaagactagaaagaagactgtatggataatcgaccaattggttttttggattcgggtgtcgggggcttgaccgttgtgcgcgagctcatgcgccagcttccccatgaagaaatcgtctatattggagattcggcacgggcgccctatggtccccgtcctgctgagcaaattcgtgaatatacttggcagttggtcaactttcttttgaccaaggatgtcaaaatgattgtcattgcttgtaatactgcgactgccgtcgtctgggaagaaatcaaagctcaactagatattcctgtcctaggtgtgattttgccaggagcttcggcagctatcaagtctagccaaggtgggaaaatcggagtgattggaacacccatgacggtacactcagacatctaccgtcagaaaatccatgatttggatccggacttacaggtggagagtttggcctgtcccaagtttgctcccttggtggagtcgggtgccctgtcaaccagtgttaccaagaaagtggtctatgaaaccctgcgtcccttggttggaaaggtggatagcttgattttgggctgtacccattatccactcctcagacctattattcaaaatgtcatgggacccaaggttcagctcatcgatagtggggcagagtgcgtacgggatatctcagtcttacttaattattttgaaatcaatcgtggtcgcgatgccggaccactccatcaccgtttttacacaacagccagtagccaaagttttgcacaaattggtgaagaatggctggaaaaagagattcatgtggagcatgtagaattatgacaaataaaatttatgaatacaaggatgaccaggactggtatgtcgggtcctatggtatttttggtggcgtccggacgttgacggatgatgacttggattttcctctattggagtttgcccaaagatttcgagatgaggatcgaggttttcctgtttctgttactgttttacgctatggttccctctaccgtttattgtcttttgtggtagatatcctcaaccaagaaatgggacgaaatgtggaagtcatccaacgtcaaggggctctgctcgtggttgaaaatgggcaactcttgtatgtggaattgcccaaagaaggggtcgatgttcatgatttctttgagacaaacaaggtcagagaaaccttattgattgcgactcgaaacgaaggcaagaccaaagagttccgagctatctttgacaagctaggctacgatgtggaaaatcttaatgactatcctgacttgcctgaagtagcagaaacaggcatgaccttcgaagaaaatgcccgtctcaaggcagaaactatttctcaattaacaggcaagatggttctggcagatgattctggactgaaagttgatgtccttggtggcttgccaggtgtctggtcagctcgtttcgcaggtgtgggagctactgaccgtgaaaacaatgccaagctcttgcacgaattggccatggtctttgaactcaaggaccgctcggctcaattccatacaaccctagtcgtagccagtccaaacaaggaaagcttggttgttgaagcagactggcatggctacattaactttgaacctaagggtgaaaatggctttggctatgaccctctcttccttgtaggagagacaggcaagtcctcagctgaattaacccttgaagaaaaaaatagtcaatctcaccgtgccttagccgttaagaaacttttggaggtatttccatcatggcaaagcaaaccatcattgtaatgagcgattctcatggcgatagcttgattgtggaagaaatccgtgatcgctatgtgggcaaagttgatgccgtttttcataacggcgattctgaactgcgtcctgattctcccctttgggaaggcatccgcgttgttaaagggaacatggacttctactccggctacccagaacgtttggtgactgagcttggttcgaccaagattatccaaacccatggtcacttgtttgacatcaatttcaactttcaaaagttggactactgggctcaggaagaagaggccgatatctgtctttatggtcacttgcatgtgccaaacgcttggatggaaggaaagactctttttctaaatccaggttctatcagtcaaccgcgtgggaccatcagagaatgtctctatgctcgtgtggagattgatgatagttacttcaaagtcgactttttgacacgagctcatgaggtgtatccgggcttgtccaaggagtttagccgatgattgccaaggagtttgagactttcttgttggggcaagaggaaacttttttgactcctgctaaaaatctagctgtgttgattgatactcacaatgcggatcatgcgaccctcttgctcagtcagatgacctatacccgtgttcccgttgtgacagatgaaaaacactttgttgggacgattgggctcagagatattatggcttatcagatggagcatgactttagtcaagaaatcatggcagatacggatatcgttcatatgacgagaacggacgtagcagttgtctcgcctgattttaccattacagaggtcttgcacaaattggtagatgagtccttcttgccggttgtggatgcgtctggtattttccaaggaattatcacgcgcaagtctatcctcaaggcagtgaatgccctcttgcatgactttagtaaggaatatgagattcgatgcaaatgagagacaagatttcagcctttttagaggaaaagcagggcttatctgccaattctaagcagtcatataagtatgatttagaacagtttttagatttggtaggtgagcggatttctgagaccagtctcaagatttaccaagcccagctagccaatctaaaaatcagcgcccagaagcgaaagatttcggcctgtaaccgatttctctactttctctatcaaaaaggagaagtggatagcttttaccgcttggaattagctaaacaagctgaaaagaagaccgaaaagccagaactgttagacctagactctttttggcaggaaagtgactatccagagggtcgcttgctagcactcttaatcctagaaatggggctcttgccgagtgagattttagctctcaaggttgaggatatcaatctggattttcaggtgttgcgaatccagaaggcttcccaacagaggattgtcaccattcccacgagcttgctttcagaattggaacccttgatggggcagacctatctctttgaaagggcagggaaagcctattctcgtcagtgggccttccgtcagttagaagcttttgtcaaggagaaaggtttctcaaccttatccgctcaagccttgcgggaacagtttattctaagacaaatagaaaagaaggtcaatttgtacgaaattgcaaaaaaattaggattaaaaacagtcctgaccttagaaaaatatagataatggatattaaactaaaagattttgaagggcccctggacttgcttttgcacctggtttctaagtaccagatggatatctacgatgtgcccattacggaagtcattgaacagtatctagcctatgtttcaaccctgcaggccatgcgtctggaagtgacgggcgagtacatggttatggccagtcagctcatgctgatcaagagccgtaaactccttccaaaggtagcagaagtgaccgatttggaggatgacctggagcaggaccttctctctcaaatcgaagaataccgcaagttcaagctcttgggtgagaatttggaagccaagcaccaagatcgggcccagtactattccaaagcgccgacagagttgatttacgaagatgcggagcttgtgcatgacaagacgaccattgacctctttttggctttttcaaatatcctagccaagaaaaaagaggagtttgcacagaatcacacgactatcttgcgggatgagtataagattgaggacatgatggccatcgtaaaagagtccttgaccggacgagatcaattgcgcttgcaggatttgtttaaggaagcccagaatgtgcaagaggtcattaccctctttttggcaaccctagagttaatcaaaacccaggagctgatcctcgtgcaagaggaaagtttcggagatatttatctcatggaaaagaaggaagaaagtcaagtggcccaaagctagacttgatagagaggaaagatgagtactttagcaaaaatagaagcgctcttgtttgtagcgggtgaagatgggattagagtccgccagttagctgaactcctctctctgccaccgacaggcatccaacagagtttagaaaaattagtccagaagtatgaaagggacccagattccagtttggccctgattgagacagggggcgcttatagattggtgaccaagcctcagttttcagagattttgaaggaatactctaaggcacctatcaaccagagtttatctcgggctgcccttgagaccttgtccatcgttgcctacaaacaacccatcacacggatagaaattgatgccatccgtggggtcaactcgagtggggccttggcaaagttgcaggcctttgacttgatacgagaagacgggaaaaaagaagtgttgggtcgccccaacctctatgtgactacagattatttcctagattacatggggataaaccatttagaagaattaccagtgattgatgagcttgagattcaagcccgagaaagccaattatttggtgaaaggatagaagaagatgagaatcaataagtatattgcccacgcaggtgtggccagtaggagaaaagcagaagagttaatcaagcaaggcttggtgacggtcaacggccaggtggtacgtgaactcgcaacgaccatcaagtcaggagacaaggtcgaagtagaaggtcaaccaatctacaacgaagaaaaggtttattatctgcttaacaaaccacgaggtgttatttccagtgtgacagatgacaagggccgtaagacagttgtggacctcttgcccaacgtgaaagagcgcatctaccctgtaggtcgtttggactgggatacatcaggagtcttgattttgaccaatgatggggattttacggatgaaatgattcaccctcgtaatgagattgataaggtttatgttgcgcgtgttaaaggtgtggccaataaggacaatcttcgtcccttgacccgtggacttgagattgatggcaagaaaaccaagccggctgtctatgagattctcaaagtggacccagttaaaaaccgctctgtggtacagttgactatccatgaagggcgtaaccaccaggttaaaaagatgtttgaagctgtcggtcttcaagtggacaagttgtcacggacccgttttggacatctagacttgacaggactccgtccaggagaatcccgtcgtcttaacaaaaaagaaatcagccaactacataccatggctgtaaccaagaaataatgaaacgaattttaatagcgcctgtgcgcttttatcaacggtttatctcgccagcctttcccccctcttgtcgctttgagcctacttgttccaattacatgattcaggctattgaaaaacatggctttaagggtgtcttgatgggcttggcacggattttacgttgccatccctggtcgaaaacaggtaaggaccccgtcccagaccacttttcactcaaacggaatcaagaagaaaaatgaggatgggtaaaaatattttagtgaaatgataaaaacgcatcctatcaggtttgagtgagtctgataggatgcgttttatcatgtaaagatgttagttgagtttgaagttgcttatttcaaggctttttgtgcgtcttcaatcatgagttttgttgattcaagaccgcctccgcttagataccagaggtctggtgtgagttggataattttaccatttttagcggcaggagtttcagcgatgagggcattttctaggacgccgtcgttgcttgagttgtccccaccgatggcaagggtacggttgatgacaaaaaggatgtcaggattgatttctttgacactttcaaagctgacttcttgtccgtggcgagagtcttcaaattgagtatctgttggcttgaatttcaaggtttggtacaagaaagagaaacgagattgggcaccaaaggcagccattttcccttcgttgaggaggatagcaagggcttttttgtcagaactttcatttttagtagcgacttcttgtatgctcttgtctagcttggccaattcttccttggctttctgtgtaccagtttcaccaaaggcgcttgctagggattcgatattagccttggtagaagtccagtagtcatctttgcctgcttggaagagaacagtcggagcgatttcgttgaacttatctacgaatttttgggtacgtggtgaagcgataattaggtctggttcaagagcagcaagggcttctaggtctggctcaaccatagaaccaacatttttaacttttccagctaggtctttaagataagtcggaacagtttttataggcattccgacgatattcttttcaaaacctaaagcgcgaatagtatccgcagcaccgaggtcaaaggtcacaatcttttcagggacttttgaaagtgtgactacacctagtgaatttttaatggttacctctgttggagcagagctacttgactccgtcttactagtgcttgagtttgtactacatgcaccaagtaggagcaagaagctggctactagggcagtgaggtaaagtttgagggatgttttcatgatttctcctttttaaaatgtgataacgatttagggagtctctaggttttattgactaagagactgaaggttctctaacttgagcttctatgttactagctatagatacagatctttttgccattgatatcagctagcgtgatgggaatctcatagagttgactgagcaggtcagcctgcatgatttgattggttgttcccttgctaaagacttgaccgtccttgaaggcgacaatttcatctgcatactgactggccatgttgatatcgtggagaacgatgataatggttttgtcgagttcctccaccagtcgccgaagaatctgcatcatgctgacgctttgcttgatatcgagattgttgagtggttcgtccagcaagataaagtccgtatcctgggccagtaccatagcgataaagacccgctggagttgtcctccagacaggctatcgatgtagcggttttttaagttggtcagttctaaatagtccagagtttcttgaattttttcccagtcttctggtctaagtcgacctcggctgtagggaaaacgtccaaaactgaccagttcttccaccgtcaatttggcttggtaattgattttctgctttaggatagtcagttcttgagccagttcttgcgaattccagctctcgatttcacggtcttttatactgagaattccctgatctttcttggtcagtctgctcatgatggagaggagagtcgattttccagcaccatttggaccaataaaggctgtcagtttctgaggactgacttcaagcgaaatgccttgcaaaatatcctgtttttgaatggatttgtcaatgtttttcagtttcaccgacgcgccctcctataaagtaagataaagaataagaagccacccacactctcgatgatcatactgatgcgaatttccatagcaaatactcgttcaattagggcttgccccaaagtcaaactgataaatccgatcagaatggccacgataaagagtaacttgtgccgatagtcattgacaattaggtaggtgaggttggctagcataaaaccgaagaaggccataggtcctaccaaggcagtagccgttgaagtcaaaagcacgataccccagaggagttctctctgttctttttcaacattgagccccaatatctgagcagtttctctttgcaggtgcaagacatcgagaatgactgctttttgaaagaaaaagattgtcaaagcgaggatgattagagaaccgatggttaggatggaagtgttgagatgttgaaaggaggcaaagagactgttttgcagtttatcgtattcatttggatccatcaggacttggaggaaggtactgatatttcgaaagagacttccgagggctagacagatcaacagaatgaagacaaggtcttgcttcatcagtgtcttcaagtagccttgtaaggcaagaaagaagagggattggatgagaagtaagattaggaattctaagataggggacttgccaagttgaagaaacttactttcaaaaaccagtagtagagtttgcagtaggacgtagaaggattcgattcctaaaatacttggcgtcaggaaacgattttccgtcagtgtttgaaaactaatggtcgaaatccctgtcgcgatagctaccaagagataaacgatgatcttttgggaacgcagcttccaggcaaaggctgacaagtgagtaatgggccaaaaatagaggagacaagctccgatggccagaataatgagaaggcagaatagcttagtatgtttgcttttagactgcatcttttcgtccccctctccagagaagtaggataaagacgaggctaccaatgattcctagtagaagactgacagacagctcatagggccgaatcagaactcgggataggatatcgcaggccagaactagattggcaccgaccagtacgaccatgagtttggtttggctcagattatctccatagtgcttgcgaacaagatttggaacgatgactacgagaaatggcaagccacccacggtaatcatggtgacactagtcgttagagccacaagaaagagggccagtttttcaagtagggagtaggaaatccccaaactctcgctggtttctttgcccagattcatgatggtgaaggtttgggataatttccaaacggctatcaggataatgaggcctaagaaaagccattcatactgatgggtctgaatcatggagaaggagccctgggtccaagctgtcatactctgaaccagattgaaacggtaggcgataacttctgtcacagaaccgataatcccactatagatgatcccaatcagaggcaacatccacctttcctttacagtaaaaatggccataaaggctaggaagaagagggtgaatacgatggatgaaacaaaagcgaagagcatcttttgagtcagactagccgacggaaagacaaagaggctcaataccattcctagtttggcggcttcagtcgttccaactgtactcggtgcagcaaactgattttgagtgatagtctgcatgaggagccctgccatactcatactagaggcagtcaggagaatgctaatggttcttggaagacgggactcttgaaagagaagccaagtttcatgatccagtgcaaagagttttccccatgaaaaatcactggtcccaatgctaatagagagaaagaccaggagtagaagtaagccaattaaataatgagaaagtttcataccccgtcctttcatgtggatttggtatcgaaagatacctgcggatattaatgtaacacgaattatttaatctgtcaataaattttctgacaatttaatgaataaaacaaggagagagcgccaaggctttctcctttgttatcctattccaaaatgtttttgccttctttaacacgccaacgataatctgataaaataatatcttcgagggagtagctagccttccaatcaagatattgtttagcttttgatgcgtctgctaggacgctagctgggtcaccagcacggcgagcaacaatttcgtgtggtattttttgattcagtaattcttcagcagttttaaagatttctttgacggtatagcctttttcagttcctaagttaaagatttgagaagaactgtcttcttgaaataggtagttcattcctttaacatgagcctgtgcaaggtccaagacatgaatgtaatcccgaatacatgaaccatcacgtgtatcgtagtcatctccaaatattttcaggctatcattttgtcccaatgcggtcttgttgatatttggaatgatatgagttggatttttcactcgcagaccgtttgaagcatccatttcagccccagctacattaaagtaacggaaaatgacatatttccaattatagcgattggccatccagtaaatcattcgttcacccatcagttttgtttctgcataagggttgacagggtcgagcagggtatcttcagttgcaggcttgtcaatacagttattaccatagagggaagcagtcgaagagaacatgattttttgaataccaacttcagataagactttgagaacttggttcatacccgcaacattggcagtgaagtatttacttggattttccaatactttcgctcacaacaatttcacccgcacaatgcagaacagcgtcaatcttgttttcttccaagtaagtttttaaggcattagcatcataaacatccagttgtttaaagctagcacgactatctacagccgctcgatttcctgtagagagattatctagaacatgtacctgatagctagcatttaaaagagctttaacggtatgggagccaatgtagccagctccacctgtaacaagaattgttttggtcatgattttttcctttttctagttttgtactattttaaagaaataagaaggagaagtcaactattttctgcaaattttatgaaaaatctgaacgattttggcatcggattgtttttttgtttgggaataaaatttcgagtgaatcttggaattttttagattttacttcaaatgcaagagaatacaattcatttctaagatagagcaaaactaagatactaacttagaaatccaccttcccgctatccttctcctataaaaagtggtaaaatggatgaaagaaagaaggaactgaaatgacaacattattttcaaaaatcaaagaagtaacagaacttgctgcgatctcaggtcatgaagcgcctgtccgtgcttatcttcgtgaaaagttgacaccacacgtggatgaagtggtgacagatggcttgggtggtattttcgggattaaacattcagaagctgcggatgcaccgcgcgtcttggtcgcttctcacatggatgaagttggttttatggtcagcgaaatcaagccagatggtacttttcgtgtcgtagaaatcggtggttggaatcctatggtggttagcagccaacgtttcaaactcctgactcgtgacggtcgtgaaattcctgtgatttcgggttctgtccctccacatttgactcgcggaaagggtggaccaactatgccagctattgcagatatcgtctttgatggcggttttgcggacaaggctgaggctgaaagctttggtatccgtcctggcgacaccatcgtaccagatagttctgcaatcttgacagccaatgaaaaaaatatcatctcaaaagcttgggacaaccgctacggtgttcttatggtgagtgagctagcagaagccctttcaggtcaaaaactcggaaatgaactctatcttggctctaacgtccaagaagaagttggtcttcgtggtgctcatacttccacaactaagtttgacccagaagttttcctagcagttgactgctcacctgctggtgatgtttatggcggtcaaggcaagattggggatggaaccttgattcgtttctacgacccaagccacttgcttctcccaggaatgaacgatttccttttgacaacggctgaagaagctggtatcaagtaccaatactactgtggtaaaggcggaacagacgctggcgcagctcatctgaaaaatggtggtgtcccatctacaacaatcggtgtttgcgctcgttatatccattctcatcaaaccctctacgctatggatgacttcttagaagcgcaagctttcttgcaagccttggtgaaaaaattggatcgttcaacggttgatttgattaaaaattattaaatcataagggaggtggtagggatggtagaaccaaacctagaaagccttgtaaaagatctttacaatcatgctcgacatgatttgagtgaggatttagttgctgctctcctagagactgctaaaaaactgcctactacaaatgagcaattgctggcagttcgtctctcaggcctggtcaatcgtgaattgctcaagaatcccagacatccggcaccctgagttgctcaacttggctcgctttatcaaaagagaagaagctaagtacagaggacccgcagcttctgcgcttatgtacggggagctctttaaaatgctttgattccattgtgaatcaaagcatttttctatatggtagaagaataattcttgattaggagaagaagaagccatcctattcaggatagcttcttggttcttagatttgttcagcaatgaccttttcagctagattcatagcatggtctgatacacgagtgtagtgggaaacaatatcgataaagttgaccccagcttgcgttgaacactcgcccttgttgaggcgtttgatgtgagtctttctgagaacacgttccatattgttgatttctttatggcgttcaattagactttgagctttttcaatgtcgttgttttccacgctatcaagggcatccttgataaagccagtggttttttgatagatatcagctagttcttgcaaagcagcttcagagaactcaacatttttacgtcgaagatagtcagtcagattgattagggcctcagcgtgatccccaatccgttccaaatcacgggatgaatcaaggatgttggtcagcacttcactttctttctggctaagggcttcacttgaaagagtaataaggtaacgagtcaatttttcatcaatggtattgatggcttcttccgtcttgtggcctttttcagcaaccttttcattgaggtcaatgatgtagttgtatgaaaggtcaaaggctttagaagcataatttcccaagtgaaggagttcttttttggcatttccgagagcgattgatggagcttgtttaatcaaatgctcatcaagataaagtggctcgtacttgacaacttcatcttcaccagggatgagcttggttacaaagtaggccaaggctccgatgaatggaaattgtacaatggtgttacttacgttaaaggcaccgtgagagaaggcgatggtcatctcaggtgagaggtgaaggagtgcctggaagtactcaatcatagatgtaaatggacctaataagattaagcaaagaatggttcctaaaacgttaaaggtaacgtgggttgcagcaacgcgtttcgcagagacattggctccagctgccgcgatgataactgttagggttgtcccgatattatccccgaagagaactggtagcgaacctttaaggtcaaggaatccacctgcatagagaccttgcaaaatcccgatcgtcgcagaagaagcttggatgaggacggtaatcactgcaccggcaaaaactcccaacacaggattttgtcccaaggttaccatgtattccttgaattgtggtaaatctttaagagggctcataccggcactgatgaggttgagggcgtagaagattccccccacaccaaacaggatgcgcccgatattgtttgctgttctgttttttgtaaagaagaggaacatggtcccaaggaaaatcaggggcaaagcatactcgccaagcttgaaaccgatgataaaggaagtaacggtagttccgatattggctcccatgataattccgatagcctgtctaagagtgagaagactagcgctgaccagcccaaccgtgataactgtaacccctgtacttgactgaatcagggcagtcacgacaattccgactagaacacctaaaaagggattgctagtgtacttgtcaatgtaaaaacgaaggcgatctccagcagcttgttgcaaaccgtctcccatggtcttgatgctatataagaatagtcccagaccacctaaaaagtgaaataaaatttcctgccaattaatggacatttctttttcctccgaaaaataataacggaatttctcctattctattttaaaggataaaagtaaatctaacaagtgttaagctaagattttagaaagaaaattcgttagaatgggccttaattatattaattttaccaatttctaacctagatatagatatttccttttatatattgacatttaaaagaaatattttaaaatgagggaggaattatcttggtccctgtgattgggataaaaattttataaagaaagttaagcgctttcttttgtgcaacaaaatcaatcttttaggaggagaaaatgaagaatctattttttgaaagacgttgtcgttacagtattcgtaagttatcagtaggagcctgctcgctgatgattggggctgttttatttgctggtccagccttagcagaagaaactgcagttcctgaaaataacggagccaatacagagcttgtttcaggagagagtgagcatccaactaatgaagctgacaagcagcatgaaggagaacatgctagagaaaataagccagaaaaggcagaaggagtagcgacagcatctgaaactgcttcgccagcaagcaatgaagctgcaactactgaaactgcagaggcagtaagcgtagctaaaccagaggaaaaaccaagtgaggtggctgcggaaacaccatctgcagaagcaaaacctaagtctgacaaggaaatagaagcaaagcctgaagcaactagccaaggggatgagtctaagccagcagcagaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcgggtctgtcgccctcgcttcacgtcggacaggtcatttggtcaatgaaaaagctagcaaggaagcaaaagttcaagccctatcaaacaccaattctaaagcaaaagaccatgcttctgttggtggagaagagttcaaggcctatgcttttgactattggcaatatctagattcaatggtcttctgggaaggtctcgtaccaactcctgacgttattgatgcaggtcaccgtaacggggttcctgtatatggtacactcttcttcaactggtctaatagtattgctgatcaagaaaaattcgctgaagctttgaagcaagacccagatggtagcttcccaattgcccgtaaattggtagatatggccaagtattatggctatgatggctatttcatcaaccaggaaacaactggggatttggttgaacctcttggagaaaagatgcgccagtttatgctctataccaaggagtatgctgctaaggtaaaccatccaatcaagtattcttggtacgatgctatgacctataactatggacgttaccaccaagatggtttgggagaatacaactaccaattcatgcaacctgaaggagataaggttccagcagacaacttctttgctaactttaactgggataaggctaagaatgattacactattgcaactgccaactggattggtcgtaatccttatgatgtatttgcaggtttggaattgcaacagggtggttcctacaagaccaaggtcaaatggaatgacattttagatgaaaatgggaaattgcgtctgtctcttggtttgtttgccccagataccattacaagtttaggaaaaactggtgaagattatcataaaaatgaagatatcttctttacaggttaccaaggtgaccctactggtcaaaaaccaggtgacaaagattggtatggtattgctaacctagttgcagaccgcacgccagcagtaggtcatacctttactacttcctttaatacaggtcatggtagaaaatggttcgtagacggtaaggtttctaaggattctgagtggaattaccgttcagtttcaggtgttcttccaacatggcgctggtggcaaaaatcaactggtgataagttgaaagcaagctatgattttgaagatgcttataatggtggaacttctctcaaatttgcaggggatctttcaggtgcgaccaagcaagatgtgaatttgtactctactcgcttgaaggtgacagatacaactaaattgcatgttgcccacaaaggaggcaaagggaccaaggtttatgtagaatttgcaaccaagaaagattatacctacggtgatgaagctgcccgtaaagaattgacagtttcagataactggactaccgatgattttgatttgagtgccttagcaggtaaaacaatttacggtattaaactctattttgaaaatgacaaagacttaaaaggttatcaatttaacctggggcaattgaccatcagcaataatcaagatgctcctcaggcaccaaccacagttgctgtagccaaacaagtccttaaaaatgcccaagaagcggaagcagttgtgcaatttaaaggcaacaaggatgcagatttctatgaagtttacgaaaaagatggagacagctggaaattactaactggctcatcttctacaactatttatctaccaaaagttagccgctcagcaagtgctcaaggtacaactcaagaactgaaggttgtagcagtcggtaaaaatggagttcgttcagaagctgcaactacaacctttgattggggcatgactgtaaaagataccagcctaccaaaaccactagctgaaaatatcgttccaggtgcaacagttattgatagtactttccctaagactgaaggtggagaaggtattgaaggtatgttgaatggtaccattaccagtctttcagacaagtggtcttctggacagttaagcggtagtgtggatattcgtttgacccagccacgtacagttgttagatgggtgatggaccatgctggagctggtggagaatctgtaaacgatggtttgatgaacaccaaagactttgacctctattataaagatgcggatggtcaatggaagttggctaaggaagttcgtggcaataaagcccatgttacagatattacccttgacaaacctatcacagctcaagattggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcggatgtaccagctggagcaaccattaccgtttatgataatccaaattctcaaactccgcttgcaaccttgaagagcgaagttggaggagacctagcaagtgcaccattggatttgacaaatcaatctggtcttctttactatcgtacccagttgccaggcaaggaaattagtaatatcctagcagtttccgttccaaaagatgacagaagaatcaagtcagtcagcctagaaacaggacctaagaaaacaagctacgccgaaggggaggatttggaccttagaggtggtgttcttcgagttcagtatgaaggtggagctgaggacgaacttattcgcctaactcacgcgggtgtatcagtatcaggttttgatacgcatcataagggagaacaaaatcttactttacaatatttgggacaaccggtacatgctaatttatcagtgactgttactagtcaagatgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagaccggtcgtcaaaccttgactcttcgttaccaaggtcataaagtcaactttgatgttttggtatctccaaaagcagcattgaacgatgagtaccttaaacaaaaattagcagaagttgaagcggctaagaacaaggtggtctataactttgcttcaccagaagtaaaagaagccttcttgaaagcaattgaagcggctgaacaagtgttgaaagaccatgaaactagcacccaagatcaggtgaatgatcgtctcaataaattgacagaagctcataaagctctgaatggtcaagagaaatttacggaagaaaagacagaacttgatcgcttaacaggtgaggctcaagaactcttggctgccaaaccaaaccatccttcaggttctgccctagctccgcttcttgagaaaaataaggccttggttgaaaaagtagatttgagtccagaagagcttgcaacagcgaaacagagtctaaaagatctggttgctttattgaaagaagacaaaccagcagtcttttctgatagtaaaacaggtgtggaagtacacttctcaaataaagaaaagactgtcatcaagggcttgaaagtagaacgtgtccaagcaagtgctgaagagaagaaatactttgcaggagaagatgcccatgtctttgaaatagaaggtttggatgaaaaaggtcaagatgttgatctctcttacgcttctattgtgaaaattccaattgaaaaagataagaaagtgaagaaagtattcttcttgcctgaaggcaaagaagcagtagaattggcttttgaacaaacggatagtcatgtcatctttacagcaccacacttcacgcattatgcctttgtttatgagtctgctgaaaaaccacaacctgctaaaccagtagaaaaagttatttcaagcaaggaaccagctgaaggtgtcaagaatttggttgtggatactccgaaattagaagttgaagagacaagtattgccttcgaacaccaagaacgtcccaatccaaatcttacagtcggtcaacgtcaacttgtccaagcaggagttgaggggcaaattcgtcgtttgattgaagtagatagtcaaggcaatcgtacgcttcgagctacagaagttttgaaagaagcaagtcctgaaatcgtagaagtaggtactggtctcattcctgccaatccagcaccacaaaacacagaccttccaaaacctactaatcaactggcttctgatcaacaaaaggctcctaaattggaagttcaagaggaaaaggttgcctttgaccgtcaagagcatgaaaatgctgatatgctagttggggaacaacgagtcatcatacagggacgagatggtctattaagacatgtctttgaagttgatgaaaacggtcagcgtcgtcttcgttcaacagaagttatccaagaagcgattccagaaattgttgaaattggaacaaaagtaaaaacagagccagcagtagcgcctacacaagaaaaaccagcccaaaatacagcagttaaatcagaagaagcaagcaaacaattgccaaatacaggaacagttgatgctaatgaagccctaatagcaggcttggccagccttggtcttgctagtttagccttgaccttgaaacagaaaaaagaagatgaagattaaatatcgaaaaatcttgtgaaatctttccttatatttccaaagtgtgatataatagtttcgaataaaataaataaaggggtttttgtaacatggcaaaacttactgttaaagacgttgacttgaaaggtaaaaaagtcctcgttcgtgttgatttcaacgtaccattgaaagatggcgtaatcactaacgacaaccgtatcacagcagctcttccaactattaagtacatcatcgaacaaggtggacgtgcaattcttttctctcaccttggacgtgtaaaagaagaagctgataaagctggtaaatcacttgctcctgtagcagcagacttggcagcaaaacttggccaagacgttgttttcccaggtgtaactcgtggtgctgaattggaagcagctatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaagctccagaacgtccattcgtagctatccttggtggttcaaaagtttcagacaagatcggtgttatcgaaaacttgcttgaaaaagctgataaagttcttatcggtggtggtatgacttacacattctacaaagcacaaggtatcgaaatcggtaactcacttgtagaagaagacaaagtggatgttgcgaaagctcttcttgaaaaagcaaacggtaaattgatcttgccagttgactcaaaagaagctaacgcatttgctggttacactgaagtgaaagacactgaaggtgaagcagtggatccaggcttccttggtcttgacatcggtccaaaatctatcgctaaatttgatgaagctttgactggtgcgaaaacagttgtatggaacggacctatgggtgtatttgaaaacccagacttccaagctggaacaatcggtgtgatggacgctatcgtgaaacaactaggcgttaaatcaatcatcggtggtggtgactcagctgccgcagcgatcaaccttggacgtgcagacaaattctcatggattagtacgggcggaggtgcttcaatggaacttctcgaaggtaaagtattgccaggtttggctgcacttacagaaaaataagattttataaacaatcaaagaagagaggaatgaaagttcctcttttcttttgcttaaaataaaaacgcttcctctcaactattactcataaaaatcaccgatttatgataaaatggaaatagaaagttgagattatgagttattttaaaaaatataaattcgataaatcccagttcaaacttggtatgcgaacctttaaaacaggtattgctgtttttctagttctcttgatttttggcttttttggctggaaaggtcttcaaatcggtgctttgacagcggtttttagtctgagggagagctttgataagagtgtccattttgggacttcgcgtattttaggaaatagtatcggtggcctctatgctttggtcttcttcttattaaatacctttttccacgaagccttttgggtgaccttggtagttgttccaatctgcaccatgttaaccattatgacaaacgtagccatgaataacaaagcaggggttattggtggtgtagcagctatgttaatcattaccctatcgattccgagtggagagacaattttgtacgtatttgcgcgtgtatcagaaactttcatgggagtttttgtcgcaattctcgtaaattacgatattgatcgtattcggctctttttagagaaaaaagaaaaataatgttacattttataacattatcaattgacgtttgtctttttttagactataatagacagaaagaaggaaattgtaaatgaaggaaaaagaatttcgccgaaatatggctgtttttcctatcggcagtgttatgaagttgaccgatctatcggcgcgtcagattcgttattatgaagatcaagagttgattaagcctgatcgaaacgaagggaaccgtcgcatgtattccttgaatgacatggatcgtctgcttgaaatcaaagattatatctccgaaggttataatatcgctgccattaagaaaaaatatgctgaacgtgaagcgaaatccaagaaagcggtgagtcagactgaggtgcgtcgtgcacttcataatgaactcctccaacagggtcgctttgcttcagtacagtcaccttttggtcgcggttaggcaaccgcaagtagtcatacattaaggagaaaactcatgccaatcacagctgcagatattcgtcgtgaagtcaaggaaaaaaatgttacctttattcgtctcatgttctcagatattttgggaaccatgaaaaacgtcgaaattcctgctacagatgaacagttagataaagtcttgtcgaacaaggctatgtttgatggatcttctattgaaggttttgtacgtatcaatgagtcagatatgtacttgtacccagacttggatacatggacagtcttcccttggggagatgaaaatggaagtgttgcaggtttgatctgtgatgtctatacaacagaaggtgaaccatttgcaggagaccctcgtggcaatttgaaacgtgctcttcgtcacatggaagaagtaggattcaagtccttcaaccttgggccagaaccagaattcttcctatttaaactggatgaaaatggggatccaacacttgaagtaaatgacaagggtggctactttgatttggcacctactgaccttgcggacaatacacgtcgtgagattgtgaatgtcttgaccaaaatgggatttgaagtagaagcgagtcaccacgaggttgcggttggacagcatgagattgacttcaagtacgatgaagttctccgtgcttgtgataagattcaaatctttaaacttgttgttaaaaccattgctcgcaaacatgggctttacgcaacctttatggctaaaccaaaatttggtattgctggatcaggtatgcactgtaatatgtccttgtttgatgaagaaggaaacaatgccttctttgatccaaatgatccaaaaggaatgcagttgtcagaaacggcctaccatttccttggcggtttgattaagcatgcctacaactatactgccatcatgaacccaacagttaactcatacaaacgtttggttcctggttatgaagcacctgtttacattgcttgggctggtcgtaaccgttcgccacttgtgcgcgtgcctgcttcacgtggtatgggaacccgtcttgagttgcgttcagtggatccaatggcaaacccttacatcgctatggctgttcttttggaagttggtttacatggtattgaaaacaaaatcgaagcaccagctcctatcgaagaaaatatctacatcatgacagcagaagagcgtaaggaagctggtattacagaccttccatcaacccttcacaacgctttgaaagctttgacagaagatgaagttgtcatagcggctctcggagaacatatctatactagtttccttgaagccaaacgaatcgaatgggcaagttatgcaaccttcgtttcacaatgggaaattgataattatttagacctttactaatactaatatagaaggaagattgtccgtgaggataatctttttttcttgtattttatatcgaggtgtgatatattttatataacgaagtgcgatatatcgaactggataggaggtagctataaatggaattaacggataagattcgtcgagtttatcttccgatgacggaaacgggcttttatatcttgttctgtctgcaaaaggaaggtcatgggtacagtattacgcaaaaggtcaaggagatgacagatttgcaagtttcgattagtcctggaactatgtatggaaccttgtcaaaaatggaaaaggatggtttgatttcctttgtccgagaagaggagaagcgtaaaatctatcagattacagacttgggaagaaaagtcttagatattgaattgaaacgtattgaacggctctatagaaacagtctggaggaaagatgatggaaaagaaggttgtttatagaattgctaccattgcggattatgatagagaggctttatatcttagaaaaatgcatgctgagggctggaaactcaaggaagtgacctactctaacttagtagttgcggttaagtatacttttgaaaagtgccaaccggagcaggtgtcttatcagttggacttttatcctatgaaaaaatcagagagagcctcctatttacaattatttaaagactgtggatgggagcatattacagactttaatggtttttcctactttagaaagcttcattctggaattgagttggatgccgagtttgaaatttataatgacgcggccgggaagctagctatggtcaaacggattttaacgaggcggatgcttcctattttgcttctctttttagctctactaccggttttctcaaagtttgtcactggaggtagttctttcagttgggaaatgtttttgattgttataatagatggtgttttattgatagttcattcgattcagatgtcttatattttttggagattgtttcaaaagtggaaagaattatctgataaataaaaccatgcatgttttctaatttggaggtgcgatgatgaaaagcaaactacaatttcggatttttacgattcttgatgaggataagaaagaagaatatttacatgagatgcacttgaaaggttggaggtatagaacgagtcgttttggttttttctattttgaccaatgtcaaccagacgatgtcatctaccgtatctatgattctagatttcttaaaaaatataagcatgaactgcaagattttagaaatagaggttgggaattgatagaaagaggtttttattcaatttttcgtaaaccggcttctaatatacttccagaggatcaagtctatatgagtaaggggctcagatgggaagttatgcgatatagatttcgttcatgtgcagctactttcttaggtggtcttgttgtttgtatgagtttgtttcgagaagaactgtcgcaatctttctttgtcatttttgctctatatgcctttatgatttcttatttaattcatggctatttaaggcttaaaagggcataccgagtagataaacagtaaggttctaggtctttagactgatttttagcactcttggcaaaagagtgctaattttttgagtttttgtcttgacattctcttttaagggtgtataatagaatcataagttagcacttgagtgtatcgagtgctaatcgatcagacagagaggagtgatgaggtggttacagagcgtcagcaggatattttaaatctgattattgacatctttaccaaaacgcacgaacctgtcggatccaaagccttgcaagagtctattaactctagcagtgcaaccattcgtaatgacatggcggctctagaaaagcaagggttgcttgagaaggcccatacttcaagtggtcggatgccaagtgttgctggttttcagtactatgtgaaacactcactggattttgaccgactagctgaaaatgaggtatatgagattgtcaaagcctttgatcaggaattcttcaaattggaggatattctgcaagaggctgctaacctgctgacagacttgagtggctgtacggtagtagcactggatgttgagccgagcaggcaacgtttgacagcctttgatatcgttgttttggggcaacatacagccttggcggtattcaccctagacgagtctcgaacggttaccagtcagtttctgattccaaggaactttttgcaggaggatttgctgaagctgaagagcatcattcaggaacgtttcctcggccacaccgttctagatattcactacaagattcggacggagattccgcagattatccagcgttactttacaacaacggacaatgttatcgatctctttgaacatatctttaaggaaatgttcaacgaaaacattgtggtggcgggcaaagtcaatctcttgaattttgccaatctggcagcttatcagttctttgaccaaccgcaaaaggtggctctggagattcgtgagggtctgcgtgaagatcagatgcaaaacgttcgtgttgcagacagtcaagagtcctgtctagccgacctagcggtgattagtagcaagttcctcattccttatcggggagttggaattctagccattatcggtccagttaatctggattatcagcaattaatcaaccaagtcaatgtagtcaatcgtgttttgaccatgaagttgacagatttttaccgctacctcagcagtaatcattacgaagtacattaagattgaaatcattaaaggaggcgaaaatggcccaagatataaaaaatgaagaagtagaagaagttcaagaagaggaagttgtggaaacggtagaagaaacaactcctgagaagtctgaattggacttggcaaatgaacgtgcagatgagttcgaaaataaatatcttcgcgctcatgcagaaatgcaaaatatccaacgccgtgccaatgaagagcgtcaaaatttgcaacgttatcgtagccaggacttggcaaaagcgattctcccttctttggacaaccttgagcgtgcactcgcagttgaaggtttgacagatgatgtgaagaagggcttggaaatggtgcaagaaagcttgattcacgctttgaaagaagaaggaatcgaagaaatcgcagctgacggtgaatttgaccataactatcatatggccatccaaactcttccagcagacgatgaacacccagcagataccatcgctcaagttttccaaaaaggctacaaactccatgaccgcatcctacgcccagccatggtagttgtttacaactaggagagagcgcttaaaaaccttgtccgaaacgacaataaactatgaagaaagataagaggcaagccggaggcttgcaaggaagatatttcccaccgtggtgaaagtttcagtagcaaaagctactgaaacaggggatttttgagacaataggctcaaaaataagtgatgaaatcccgtagggagttgctcacgtccccaccacttaagggaaatataaaaaaatagaaaattaactaacaaggagaaaaacacatgtctaaaattatcggtattgacttaggtacaacaaactcagcagttgcagttcttgaaggaactgaaagcaaaatcatcgcaaacccagaaggaaaccgtacaactccatctgtagtctcattcaaaaacggtgaaatcatcgttggtgatgctgcaaaacgtcaagcagttacaaatccagatacagttatctctatcaaatctaaaatgggaacttctgaaaaagtttctgctaacggaaaagaatacactccacaagaaatctcagctatgattcttcaatacttgaaaggttatgctgaagactaccttggtgaaaaagtaaccaaagcagttatcacagttcctgcttacttcaacgacgctcaacgtcaagccacaaaagacgctggtaaaatcgctggtcttgaagtagaacgtatcgtcaacgaaccaactgcagcagctcttgcttatggtttggacaagactgacaaagaagaaaaaatcttggtatttgaccttggtggtggtacattcgacgtctctatccttgaattgggtgacggtgtcttcgacgtattgtcaactgcaggggacaacaaactcggtggtgatgactttgaccaaaaaattatcgaccacttggtagcagaattcaagaaagaaaacggtattgacttgtctactgacaagatggcaatgcaacgtttgaaagatgcagctgaaaaagctaagaaagacctttctggtgtaacttcaactcaaatcagcttgccatttatcactgctggtgaagctggacctcttcacttggaaatgactttgactcgtgcaaaatttgacgatttgactcgtgaccttgtagaacgtacaaaagttccagttcgtcaagccctttctgatgcaggtttgagcttgtcagaaatcgacgaagttatccttgttggtggttcaactcgtatccctgccgttgttgaagctgttaaggctgaaactggtaaagaaccaaacaaatcagtaaaccctgatgaagtagttgctatgggtgctgccatccaaggtggtgtgattactggtgatgttaaagacgttgtccttcttgacgtaacaccattgtcacttggtatcgaaacaatgggtggagtatttacaaaacttatcgatcgcaacactactattccaacatctaaatcacaagtcttctcaactgcagcagacaaccaaccagccgttgatatccacgttcttcaaggtgaacgcccaatggcagcagataacaagactcttggacgcttccaattgacagatattccagctgcacctcgtggaattcctcaaatcgaagtaactttcgacatcgacaagaatggtatcgtgtctgttaaggccaaagatcttggaactcaaaaagaacaaactattgtgatccaatcaaactcaggtttgactgacgaagaaatcgaccgcatgatgaaagatgcagaagctaacgctgaagcagataagaaacgtaaggaagaagttgaccttcgtaacgaagtagaccaagcaatctttgcgactgaaaagacaatcaaggaaactgaaggcaaaggcttcgacgcagaacgtgacgctgcccaagctgcccttgatgaccttaagaaagcgcaagaagacaataacttggacgacatgaaagcaaaacttgaagcattgaacgaaaaagctcaaggccttgctgttaaactctacgaacaagctgcagcagcgcaacaagctcaagcaggagcagaaggggcgcaagcaacaggaaacgcaggcgatgacgtcgtagacggagagtttacggagaagtaagatgagtgtattggatgaagagtatctaaaaaatacacgaaaagtttataatgatttttgtaataaagctgatagttatgaatctgcaaaagattttatagataatattccagtagtgtatttggctaggtataaagcaattattttagctgagcatgaaagttgtgttaaaaatgatgaggcggtaaggaattttgttacttcagtattgttgtcagcgctagtatcagcactagtatcagcaaccatacaaaaaccagaatttataatatcgtttataattggcatggtttgggttgtctgtgttttccttctaatctattggaattttatagccaatactaagaagagacaaaaatatataaatgtttgtgtgcttattggatatttaaaatcaaaataaatttgatttaagttacttcactcatccacagaggttgcaatccagcctctgtttttcgataaaatagaggatgttgcgtatgaaaaaagtactttgtatcatttatcctaatttttctctttatgagataaccactttaacgagtactttagctctgtcttttgatatcacgattgattatgtcgcttctgagaattcgatggtagtctctgaggatggtttgccctgtcaaccgacgaaaacattggatcagctctgtatagaagattattcttgtgtaattttgccaggaatggtcaatataggtcctgctctacaagatgagaaattgatttcgtttttgagaagtcttaatgagcaagatatcctaattgcagccatttcttcagcgcccattttactagcgaaagctggcttgttgaacgacacgaaatttacaggtggaatttggcaaaacttctttgattattttgaatttcttccacgtaagaattttcaaccgaaagttcttgtccaagataaacaaatcattacggctatcggttttgcacatcaagagtttgcaagaaaagtgattttcggtttagggttggcagagaatacggacaactattttaaagaacagaacgagtatgctgaagaggatttgatatttactctatcagatgaagagtttaatcaagtgaagcagagtatagaaaacagcctctaaagatttacatgaaaattatagaaaggaacaaaggtgttcagggaattgaacacgggttcccaaatttattactcaatataaaagaaaggaattgaacccgacctaaattctcggaaaaaagataaatctgcctaggagcatcgctccagcgtcagatttcctatttttcagtcgaattttacggtcttggtatcttgtatgaacaatactgaattttatgatcgtctgggggtgtcaaaaaacgcttcggcagacgagatcaaaaaggcttatcgtaagctttcgaaaaaatatcacccagatatcaataaggagcctggtgctgaggaaaagtacaaggaagttcaggaagcttatgagactttgagtgacgaccaaaaacgtgctgcctatgaccaatacggtgctgctggagccaacggtggttttggtggagctggtggtttcggcggtttcgatggggcaggaggcttcggtggttttgaggatattttctcaagtttcttcggcggaggcggtgcttcgcgcaatccaaatgctcctcgtcagggggatgacctccaataccgtgtgaatttgacctttgaagaagctatttttggagctgaaaaagaggttaagtacaatcgtgaagcaagctgtagtacatgtaatggctcaggcgctaaaccaggaacaagtccagtcacttgtggacgctgtcatggcgctggtgttattaacgtcgatacgcagactccgcttggtatgatgcgtcgccaagtaacctgtgacgtctgtcatggtcgcggaaaagaaatcaaagatccatgtaccacttgtcacggaacaggtcatgaaaaacaagcccatagtgtacatgtaaaaatccctgctggtgtggaaactggtcaacaaattcgcctagcaggccaaggtgaagctggatttaacggtggaccttatggtgacttgtatgtagtggtttctgtggaagccagcgataagtttgaacgtgaaggaaccactatcttctataatctgaaccttaactttgtccaagcagctcttggtgatacagttgatatcccaacggttcacggtgatgttgaattggttatcccagagggaactcagactggtaagaaattccgtctacgtggaaaaggagctccgagccttcgtggtggtgcagttggtgaccaatatgttaccgttaatgtcgtaacaccgacaggtttgaacgaacgccaaaaagcagcgcttaaagaattcgcagctgctggtgatttaaaagtcaatccaaagaaaaaaggcttctttgaccatattaaagatgcctttgaaggagaataaaacaaaaagagccgttgggctcttttttgtttatagattttttaagactttccttaagtaatgacggacggtagcgaccttcttcgaagttccatacctaaactttgagcctaggtctcaaagtttccgaacatctgaaagcaagctgtttcagatgttttcattccgtcggaaagtcttggatttagttgtgaaatggtgaatgagttgcctaaattatgatgtataattaatgggatataacttgtttaccttttaaaaaagagccgtcgggctctttttacttatcttcagtttcctgcagttcttttatcacagctagtctagtctggatatctttttccaagaccttaaacttgtaagttaggtcttcttgatattccttgatgagttctttttgctggtcgatgatttgcaggctattttggataatatccacatcatccttgatagcttgaacacggtcagtggtattcaagacttcatctgtgatggtttggcgattttttgtgaccagataacttccggctgcagctcctgcaaatagcagtaggttggataatttcatggcaactccttaggcgtttttgatagtttcagcgacttgagcaagtttgtcaaagtctggttcgtgggcgataaaatcaatcttgaggtcatcgtccgcactgtagcgaggcacgagatgaacgtgggtatgaaagactgtttgaccaccgatttcttcacagttggcaatgatattcataccagcagccttggtagctttcatgactttttgagctacttttggtacttgggcaaagagttggctggcgctagtagcatccatttctaaaagattgcgatagtgttcctttggcacgaccaaggtgtgtcctggtgtcacttgagagatatcaagaaaggcaagaacctgctcatcttcatatacttttgatgcaggaatttcccctgcgatgattttacaaaaaatgcaatctgacataaaatctacctctactgtattgaattttgatataatatagctacattataccagatttggagaaaatatgttagaaattaaaaacctgacaggtggctatgtccatgtccctgtcttgaaagatgtgtcctttacagttgaaagtgggcagttagtcggtttgatcggtctcaatggtgctgggaaatcgacgaccatcaatgaaattatcggtctgttgacaccttatagcggatctatcaatatcaatggcttgaccctgcaagaagatgcgaccaactaccgcaaacagattggttacattcctgagacacccagtctgtatgaggaattaaccctcagagagcatatcgaaacggttgctatggcttatggtatcgagcaaaaagtggcttttgaacgagtagaacccttgttaaaaatgtttcgtctggaccagaaattagactggttccctgttcatttttcaaaagggatgaagcagaaggttatgattatctgtgcttttgtggtggatccaagtctctttatcgtggatgagcctttccttggtcttgatccgctggcgattgcggacttgattcagcttttgaaagtggaaaagcaaaagggcaagtccattctcatgagtacccacgttctggattcggcggagaagatgtgtgatgcctttgtcattctccacaagggggaggtgcgtgctcatgggaacctccagcaactccgcgaagcctttaacatgcctgaggctagtttgaatgatatttacttggctctgaccaaagaggaggagttatgaaagacttgtttttaaagagaaagcaggcttttcgtaaggagtgtcttggttatctgcgctatgttctcaatgatcactttgtcttgttcctgcttgtcctgctgggatttctagcctaccagtacagtcaactcttacaacattttcctgaaaatcattggcctatccttttgtttgtagggattacatctattttacttttgctttggggtgggattgtcacttatatggaggcaccagacaagctctttctcttggtcggagaagaggaaatcaagctccatctaaagcgtcaaattgccacttccctagtcttttggctctttgtacaaacccttttcttgcttttatttgcgcccttatttttggcaatgggttctggcttgccagtttttctggtctatgtgctcctattgggggtagggaaatatctgctctttcgtcaaaaagccagcaaatttttcactgaaactggactggactgggactatgtcatttcccaagaaagcaagcgtaagcaagtcttgcttcgtttctttgctctctttacgcaggtcaagggaatttcaaacagcattaagcgtcgtgcctatctggactttatcctaaaggttgttcagaaggtgcctgggaagatttggcaaaatctctatctgcgttcttatctgcgaaatggagacctctttgccctcagtctccgtctgctcctactttccttgctggcgcaggtctttatcgagcaagcttggatagcgacagcagtggtggttctctttaactacctcttgctcttccagttgctggccctctatcatgcctttgactaccagtatttgacccaactctttccactggacaaggggcaaaaggaaaaaggcttgcaggcggtagtccgaggattgaccagtttggtcttagtagtggaattagttgttgggttgattaccttccaagaaaaactagcccttctagccttactgggagctggtttggttttactagtcttgtacctaccttatcaggtcaaacgtcagatgcaggactaacattgtctatatgacactaaaaaagaagttgagttcagtttgtctcagcttcttttattttctacaagagaatggttggaccgtagagacttaacttggtcttgacttggtcaaagtggaagcggtcataggcccgccaagcggcgcgagttggagcatctggatcaagagcgctgagtcccatgagaagactggaagtctggtaaaatttttccagttcaatcaagactcgattatccactgtttcagccttggctagaaaaccaagaatagagtttaattgctcctgaaagcggacgtcgtcagcggttgcctgtttgcatgcttgataggctttgtttaagtcagtaatcaaagtctgagctcttttgatagggtctgtatctgtcatgagaattcctcctttaatctaggtgctagttttgattctagcaactgtgttttgatactgttagtctatcacttttatctcctttttcaccataaaatctttaattgcccttgaaatttcctgaatgatactgttaagattttatgataaaatagttgtaagattatcatgcttatttgaggaacaagatacccttcaggagcgttaaaggcctgtttaggatttggtgggcttgtatcaaagtatttttgctattctctttttaggaagaaatcgaaacaaggagagtaagaagatgagaatatttgttttagaagatgatttttcccaacagactaggattgaaacgacgattgagaaactcttgaaagaacatcatatcactcctagctcttttgaagtctttgggaaagcagaccaactgctggcagaggtgcatgagaagggggcgcatcagctattctttttggatattgagattcgaaatgaggagatgaagggtctggaagtggctagaaagattcgggatcgggatccttatgccctgattgtctttgtgacgactcactcggagtttatgcccctgtcctttcgctaccaagtgtctgctttggactacattgataaggctttgtcagcagaggagtttgaatctcggatcgagacagccctcctctatgccaatagtcaagatagtaagagtctagcggaagattgcttttactttaaatcaaaatttgcccaattccagtatccttttaaagagatttactatctcgaaacgtcgcccagagcccatcgtgttattctctataccaagacggacagactggaatttacagcgagtttagaggagattctcaagcaggagcctcgtctcctgcagtgccatcgctcttttctcatcaatcctgccaatgtgatacatttggataagaaagaaaaactccttttcttccccaatgggagaagttgcctgatcgcgcgttataaggtcagggaagtgtctgaggctatcaataacttacacttagtgaggtgatggaatggaaatagtttggaaaatagtttatacatttttggtatctggattggagttgtttatattttttaaggtagatggaattggtctcacttttgagaggatttttaaggcctttctttttaagatactgttggcatttgtttttgtaacaattaactatatagtaggaaatgattacctatcttattttacggaaccattgtacggtatcggcttatctttcttattgtttagagggcttcctaaaaaactccttatcttttatggtctctttccaatgatattggtaaatctcttttatagaggtgtttcctattttttgcttccgtttttagagcaagggcaactatataatgactactcatttacttggttatgtataataattttcaatttcttcatttctctagcctttttgagatggttagactatgatttcactagcttgagaagggagagtatagataaagattttcaaaaatccctgactacgattaactggataatgggggcttactttctagtcatggaaactttgtctttctttgaatatgaacaagttatccaatcaaagactgttcgccattttattctagtgttttacctactcttttttatggggattgtcaagaagctagatacctatttgaaggacaaacttcatgagagattggacaaagagaaggccttgcgctacagagatatggagcggtatagtcggcatatagaggaactttacaaggaagtccggagttttcgccatgactacaccaaccttttgaccagtttacgtctgggcattgaagaggaggatatggagcagataaaagaggtctacgactcggtcttaaaggattctagtgaaaaattgcaggacaacaaatatgacctgggcagattggtgaatattcgggaccgtgccctcaaaagtctcctcgcgggaaaatttctaaaagccagagataagaagattgtctttaatgtcgaagttcctgaggagattcaagttgagggaatgagcttgcttgactttctaaccattgtgtctattctttgtgacaatgccattgaagccagtgtagaggccagtcaacctcacgtttcaattgcctttttaaaaaatggagaacaagagacctttatcattgaaaactccatcaaagaagagggcatcgatatttctgaaatcttctcctttggagcaagttcaaaaggggaggagagaggtgttggtctctataccgttatgaaaattgtggaaagccatcccaataccagtctaaatactacctgtcaaaatcaagtctttcgtcaggttttaacggttcactcgatgtcagttgataattagaagatttgtgaaaaaagaattgggagaagctaacagataagttttgtctttatccagtttgatttttaccatagtatacgaggtatattaaatgaataagaaatcctattttatcgtctgttctacgttgatcatagcatcgaatcttctcatgatttccgtggtgaacaagggggaagaaacggggagcaatctgtttgtgattgctatagcctgtgttatgttaccgtcctttttatatgcggttgagaaccgactgacttctttaattgggacagagtcagtagctctactcttattgacagtattgtctttagtccgtcttgtcaacagaatagagaggacgcctgaaatcctcaacattatcattaccctcctggttttggcaggtgggacagcctgtatcctggttgcgatcatgagaatctatcataacagacggaagtaagggtgaatagctttcgatgtatttttacattgttaaatttccatagggcaagtatgtttttcatgcttgcttttttaaatttcttacaattcgagatgttttgatgaccatttgtgatttggatggaaaatgttaaaaaatagtagtatactaaccttattaaggttgtaataggacgaaagtaaaaagaggtattcctcgtgaatgcaaaaacaatgttacaattgtctattatggttgcttaacggcttaagcctgcatgtagaggagctgtacttggaggtaattatggatttcaaaagttttcttattgtttttgttgttggtatgtttgtttcttttattacttctttaattagggaaaaatttttaaaatctccaaagaagaataaagatagatctaattagataaagagatttttatcgctagtttaatctacagaggagtttctttaatattgtttcgcctgtcaaaatgatatgtgatagcaggataaaaaatctacaaattaagttggtatcaatatggtgtaaagggcaagtatgtttttcatgcttgcttttttaattttttacaattcaagatgttttgatgaccatttatgatttgagtgttccaaagataaaatgagtgctatactagcagtgtaaaggttgtagctcaactaagataaagcatacatttaggaggaaattttatgaagaaaaaaatactgattattttcgttctatatctgatcatgtctatccttctttatccgcttagggagagtacttggtatcatctattttataccatagcctatatgattgcggttgtgatctattttgctttaactaaaaagaaaggagaaaagaaatgaaaacttttcttgctaaaaaacggaacgtcttccttgcgagactgttcctaggtcagttgcccttacttgtctctacttatctatttctatctcgtcagtttttaaatttttccttggttttccaatttcttttagtggttcttaacttggcttcgattttagtcactgtttacctcactagagaaatgaggataagaaagtttgaagacgatgatttggttagtcctagaaccaatcaactcatgtatatcggcttgacaggctttatgtctattatctgtttgtatagaggtatcacagcaggagaatcctatcaacaattaattgcctatattggtgctattctctgcttgattattatgcttctactcatttggggcttgaagtattataaaaagtagaggctaatgaagtttttgttatgaatacaaaaatgatggaacaatttgaggttatggatactgagatgcttgcgaaagttgaaggaagtttcggaggttggggagatatgctttctggtttattgggtgggctagcaccttctccaattttggatcaattaaatggtaagtggcctattatacatttttcaaaaccatgtggtccttatggtatagggggaactccaaactcatgtaatggtatttaaaaaggattgaagctatgaaggcaaaatatgggaatcaaattgttgatgtttgggaaattggtcaagcaactcctaaaccaagttgggtagaggaagcttttcaaaaaaattatatggtttggttggataatcatgtgcgcattctaatggcaggtcttaacacttctcttgcaactaatatcaagtttggtctagttggaacagttggaggaggattcgctggttatggaatgtatgttcttggttatccaggtgattatatagatatcaccaatcatagagttgtttctgctaaaacatttcacaaaagttatcaaattttagaaaatgattagatatcatttaattgtaatggagaaagcaatgaaaaaaatattttttaaaaaacggaacatcttccttgcgagattgttcttaggtcagttgcccttacttgtctctacttatctgtttctatctcgtcagtttttaaatttttccgtagttctccaatttcttttagtggttattaacttggcttctattttggtcactgtttacctcactagagaaatgaggataagaaagtttgaagatgatgatttggttagtcctagaaccaatcaactcatgtatatcggcttgacaggttttatgtctattatttgtttgtatagaggtgtcacagcaggagaattctatcaacaactaatcgcatatattggtgctgttctctgcttgcttatcatgcttctactcatttggggtttgaagtattataaaaagtagaggaagggttttcttcttaatctgggactagtctaaagactggcaggaggaggttatcatgtataaacacttatttttcctagattcaaaaaccttagactggttgacaccttatattctggtcttggcttctgacaccattgcttttaatgtttttgtgctaacctttgtatctgtggtggtcttttatttcctaaatcccatgttatctttaatggctatcttcttaggggctggctatgtggtcggattttggttgctaaaatggtttgttttggaaaggttagagttaaaggatgacttgtagggaagtttgtttgttgaggaggctagttttatggagttttttgataaatttcatgccttttgttttggatttttagtactactaatcgtcattacagttccttatacgattaaccacggggatttttttcaaaatgaatctgaattgattattgtaagtcttcttgtaacctcgctgagtgttacttatgctagaaagtttgaaatggtttcttttgggatgttaagcaagaaacaacttttgcttttcattgcaatcttttttctaagcgttcttgagacgctagtttatattcatttcttcgctgtttcttctggcgcaggagttcaacacttggcggaagtcagcagaggaatttccctgtctttgattttgacttcctcagtttttggacccatccaggaggaactcattttcagaggacttcttcaaggtgcggtttttgacaattcttggttagggattgtactgacttcctctctcttttcttttatgcatggaccttctaatgtcccttcgtttattttttatctacttgggggcttgttactgggctttgcttataaaaagagccaaaacctatgggtttctactctagttcacatgttttacaatgcttggccactcttatattatttataaaaattatgaaaggtaagtagaagacggtgcttacctttttctttctataatgatacccaagccaccccagaggcttttctttgagaatcgggcgtggagcggttgacgaataggccaaaaactagtagaatagtaaggaaactttatacggaggaaagaaatggatttgggtgataatgagctaacactgactcccatacctgggaaaagtggcaaggcttatatgggtagctatcctgatgggaagcgtatctttgtaaaaatgaacacctctccaatcctacctggtctagctagagaacaaattgctccacaattattatggagtcgccgtttggcagatgggcgtgatatgtgtgctcaagaatggttgacaggcaaaatattgaccccttatgatatgaatcgtaaacaaatcgtcaatattttaacccgtcttcatcgctcacgtccgttgatgacacagttgagtcggttgggatatgccatggaaacacctgtagatttactacagtcttggcaggaaacggctccagatgctttgcgtaaaaatcattttatcagtgaagtgatggctgatttacgtcagactattccaggatttagagaggatcatgcgactattgtccatggagatgtacgacatagtaattggattgagacagacagtggcttgatttatttggtagattgggattcggttcgcttgaccgaccgcatgtttgatgtggcccatatgctctgccattatattccagaacatcagtggaaggaatggttgacctactacggttacaagtacaatcaaacggtattaaataaattgtattggtacggtcaattgtcttatttgagccagatttccaagtattatatgaaccaagatttagaaaatgtcaatcgggagattcatggcctgcgtcacttccgagacaagtatggaaagagaagatgagagttagaaatcgtaaaggggcgacagaattactagaggcaaatccccagtatgtggtcctcaatcccttgggagccaagggaaaatggcgggacctgtttggcaatgacaatcccattcatgtggaagttggaagtggaaagggtgcctttgtttcaggtatggccaagcaaaatcctgacatcaactatatcgggattgatattcaaaagtctgttttgagctacgctttggacaaggtgcttgaagttggagtgcctaacattaagctcttgtgggtagatggttctgacttgactgactactttgaagacggtgagattgatcgtttgtatctgaacttttcagatccttggcctaaaaaacgccatgaaaagcgtcgtttgacctacaaaaccttcttggataccttcaaacgtatcttgcctgaaaatggagaaattcatttcaagacggataatcgtggcttgtttgagtacagtttagtgagcttttctcagtatggcatgaagctcaatggtgtctggcttgatttacatgccagtgattttgaaggcaatgtcatgacagaatacgagcaaaaattctccaacaaggggcaagttatctaccgtgttgaggcagaattttaagaaatagcctgaaatcaggctgtataagtgcttttgctttacataagttggcaaacgtgctatactaagagtaagaatatgagaaagtgaggcggggaaatatcttcgcctcttgcttatgaggaggtggacgcaatcgcaacaatcgtagaattagtcagagaagttgtagaacctgtcatccaagcacctttcgaactcgtggatatcgagtatggaaagattggcagtgacatgattctcagtatttttgtagataaacctgaaggaattaccttgaacgacacggcagatttgacagaaataatcagtcctgtcctagacactatcaagccggatcccttcccagaacaatatttcctagaaatcaccagtccaggtttggaacgtcctttgaaaaccaaggatgcagtcgctggagctgttgggaaatacatccatgtcgggctctaccaagccatcgataagcaaaaagtctttgaaggaaccttgttggcctttgaagaggacgagttgaccatggaatatatggacaagacgcgtaagaaaactgtccaaattccatacagtttagtatcaaaagcacgtttagcagttaaattatagaaaaagaaaggatagcttttgaggattcaaaagtgaagaaaacatgagtaaagaaatgctagaggccttccgcattttggaagaagacaagggaatcaaaaaagaagatatcatcgacgcagtagtagagtcgcttcgttccgcttatcgcagacgctatggtcaatcagacagcgtagctattgactttaacgaaaaaacaggtgactttaccgtttatactgtccgtgaagtggttgatgaagtatttgatagccgtttggaaatcagcttgaaagatgctcttgccattaattcagcctatgaacttggtgacaaaatcaagtttgaagaagcacctgctgagtttggtcgtgtagcagcccaatctgccaaacaaaccatcatggaaaaaatgcgcaagcaaacacgtgccatcacttacaatacttacaaagagcatgagcaagaaatcatgtctggtacagtagaacgctttgacaaccgctttatctatgtcaacctcggtagcatcgaagcccaattgtcaaaacaagaccaaattcctggagaagtttttgcttctcatgatcgtattgaagtttatgtctacaaggttgaagacaaccctcgcggtgtcaacgtctttgttagccgtagccatccagaaatgatcaaacgcttgatggagcaagaaattccagaagtttatgacggaacggttgaaatcatgagcgtagctcgtgaagctggtgaccgtactaaggttgccgttcgcagtcataatccaaacgtggacgctatcggaacaatcgttggacgtggtggagctaacatcaagaaaatcactagcaaattccacccagctcgctacgatgccaagagcgaccgtatggtcccaatcgaagaaaatatcgacgttatcgagtgggtagcagatccagctgaatttatctacaatgccatcgctcctgctgaagttgaccaagttatctttgatgaaaacgacagcaaacgtgccttggtggttgttcctgataacaagctttctcttgccatcggtcgtcgtgggcaaaacgttcgcttggcagctcacttgactggttaccgtatcgatatcaagtctgctagcgaatttgaagccatggaagaagctggttcggtagatttggaagcagaaaacgatactgtagaagaataaaagctgctagaggagggaaagatgaaaacgagaaaaatccctttgcgcaagtctgttgtgtccaatgaagtgattgataagcgtgatttgctccgcattgtcaagaacaaagaaggacaagtctttatcgatccgacaggcaaggccaatggccgtggcgcttacatcaagctagacaataaagaagccctagaggcgaaaaagaagaaggtctttaaccgtagctttgacatggaagtagaagaaagcttttatgacgagttgattgcttatgtggatcataaagtaaaaagaagagagttaggacttgaataagcaaaaaataagcaatctcttgggacttgctcagcgagcagggcgaattatatcgggtgaggaattggtcgttaaagccattcaagacggcaaggccaagttggtctttctagcccatgatgcaggccccaatctgaccaagaagattcaagataaaagtcactattatcaagtagaaattgtaaccgtgttttcaacactggaattaagcatagcagtcggaaaatcaagaaaggttttggctgtgacagatgctggatttacaaagaaaatgaggtctcttatggaatagaagaggaggacatgatttgtctaagaaaagattgtacgaaatcgcaaaagaacttggaaaagaaagtaaagaagttgtagcgcgtgcaaaagagttgggcttggatgtgaaaagccactcatcaagtgtggaagaagctgtcgctgcaaaaatcgctgccagctttaagcctgcagctgctccgaaagaagaagcaaaacctgcagcaccaaaagcaagtgcagaaaagaaagccgaaaaatctgagccagctaaaccagctgtagctaaggaagaggcaaaaccggctgagccagttgctccgaaggcagaaaaagtagcaacaaaaccgcaaagccgtaatttcaaggctgagcgtgaagcccgtgccaaagagcaggcagaacgacgcaagcaaaacaagagcaataaccgtgaccaacaacaaaacgggaaccgtcagaaaaacgacggccgcaatggtggaaaacaaggtcaaggcaaccgcgacaatcgccgttttaacgaccaagctaagaaacagcaaggtcagcaaaatcgtggaaatgagcgtcgtcaacaagaggacaaacgtccacatcaagcggctccacgtgttgactttaaagcccgtgcagcagccctaaaagcagagcaaaatgcagaatatgcccgttcaagtgaggaacgtttcaagcagactcaggctgccaaagaagccttggctcaagctaacaaacgcaaggagccagaggaaatctttgaagaagtggctaagttagctgaacaagcgcaacaagttcaagcagtggttgaaccagctcctgtagctaaagaagcgccagtggatacacgtcgtaaaaaacaagctcgaccagacaaagaacgtgatgattatgatcacgaagacgatggtcctagaaaacaacaaaagaatcgaagtagtcaaaatcaagtgagaaatcaaaagaatagtaactggaataacaacaaaaagaacaaaaaaggcaataacaagaacaatcgtaatcagactccaaaacctgttacagagcgtaaattccatgaattgccaacagaatttgaatatacagatggtatgaccgttgcggaaatcgcaaaacgtatcaaacgtgaaccagctgaaatcgttaagaaacttttcatgatgggtgtcatggccacacaaaaccaatccttggatggggaaacaatcgaactcctcatggtggattatggtatcgaagccaaacaaaaagttgaagtggataatgccgacatcgaacgtttctttgtcgaagatggttatctcaatgaagatgaattggttgagcgcccaccagttgtaaccatcatgggacacgttgaccatggtaaaacaacactcttagatacccttcgtaactctcgtgttgcgacaggtgaagcaggtggtatcactcagcatatcggtgcctaccaaatcgtggaaaatggtaagaagattaccttccttgatacaccaggacacgcggcctttacatctatgcgcgcgcgtggtgcttctgttaccgatattactatcttggtcgtagcggcagatgacggggttatgcctcagactatcgaagccattaaccactcaaaagcggccaacgttccaatcatcgtagctatcaacaagattgataaaccaggtgctaacccagaacgtgttatcggtgaattggcagagcatggtgttatgtcaacagcttggggtggagattctgaatttgttgaaatctcagctaaattcaaccaaaatatcgaagaattgttggaaacagtccttcttgtggctgaaatccaagaactcaaggcagacccaacagtgcgtgcgatcggtacagttatcgaagcgcgcttggataaaggaaaaggtgcggtcgcaacccttcttgttcaacaaggtaccttgaatgtccaagacccaatcgttgtcggaaataccttcggtcgtgtccgtgccatgaccaatgaccttggtcgtcgtgttaaggttgctggaccatcaacaccagtttcaatcacaggtttgaacgaagcgccaatggcaggtgaccactttgccgtttacgaggatgaaaaatctgcgcgtgcagcaggtgaagagcgtgccaaacgtgcccttatgaaacaacgtcaagctacccaacgtgttagccttgaaaacctctttgatacccttaaagctggtgaactcaagtcagttaacgtcatcatcaaggccgatgtacaaggttctgttgaagccctttctgcatcacttcaaaagatagacgtggaaggtgttaaagttactatcgttcactcagcggtcggtgctatcaacgaatcagacgtaacccttgccgaagcttcaaatgcctttatcgttggtttcaacgtacgccctacaccacaagctcgtcaacaagcagaagctgacgatgttgagatccgtctccacagtattatctacaaggttatcgaagagatggaagaagctatgaaagggatgcttgatccagaatttgaagaaaaagttattggtgaagcagttattcgtgaaaccttcaaggtgtctaaagtgggaactatcggtggattcatggttatcaatggtaaggttacccgtgactctaaagtccgtgttatccgtgacggtgtcgttatctatgacggtgaactcgcaagcttgaaacactacaaagacgacgttaaggaagttacaaacggtcgtgaaggtggattgatgatcgatggctacaatgatatcaagactgatgatgtgattgaggcctacgtcatggaagaaatcaagagataagattttttgctcctttcttaggtggtgagggacgcaagcaaaccgatggtttcattgcttatttttgagcctagagtctcaaaaatcccctgtgatgggactgataaatcagttccatcactttcaccacggcgaaagaagcagatgatttcaaattgaacttcgttccaatttgaaatgaaaatcaataaatttaaaaatagctaggtctgctggcctagcttttggttcaaagtagagaaaggaatatcatggcaaatcattttcgtacggatcgtgtgggcatggaaatcaagcgtgaagtcaatgagattttgcaaaagaaagtccgtgatccgcgtgtccaaggtgtgaccatcacagatgttcagatgctaggtgacttgtctgttgccaaggtttactataccattttgagtaaccttgcttcagataatcaaaaagcccaaatcgggcttgaaaaagcaactggtactatcaaacgtgaacttggtcgcaatttgaaattgtacaaaatcccagatttgactttcgtcaaagacgaatccatcgaatatggaaacaagattgacgagatgctacgcaatctggataagaactaaaaaggaggggaaaccctcttttttgtgggggaaaaggcaataaaacatgctggcggaatatttccagagttatattaaaaagctttataaaattcaacttgtatgatattataggaaataaaaagagtgagagagaacgatttttcagaaataggcaacaaggctggtatcgatatcattttgaaagtgtagttaaacgaggaaagataatatgggactcataaaaattctagctaaaacttacgggaattactttttgaccatgcaaggtgtaaaagtcatgaaaacgataaagaaagatgaccatgtcgttgttggtctggggaaactttttattgcagacaagttaatggatacggctcggtggctcatcaagccagaggagagagaatgaaatttttctgggcgattcttgctattctttttatcaaaccaattattggaattatgaaattcctgtggatgatcatctcttttgcagtccaattgctactctataagatattatttaagatattggattggctctttaaacttatttagatggtcatccaagtcgtggggaactagcaggtcttgtactgctagttttttaatctctctccatatggtataatataagcagtaaaatcattttatactcttcgaaaatctcttcaaaccacgtcagcgttgccttgccgtaggtatggttactgacttcgtcagttctatccacaacctcaaaacactgttttgagcagcctgcggccagcttcctagtttgctctttgattttcattgagtattagaacatacaatggaggtcgtcatggacaatatcatcgatgtgtcaattcctgttgcagaagtggtggacaagcatccagaagtcttggaaatcctagtggaactcggttttaaaccacttgctaaccccttgatgcgcaacacagtcggtcgcaaagtatcgcttaagcagggttctaagctggaagggactcctatggacaagattgtccgcacactggaagcaaatggctacgaagtgattggattagactaatggcagatgagcgaattcatatcctacgggatattttgttagaattgcacaatggcgcctctcctgagtcggttcaggagcgctttgatgcgacctttacaggtgtttcagccatcgagatttcccttatggagcacgagctgatgaactcagactcaggtgtcacctttgaagatgttatggaactttgtgatgtccatgccaatctttttaaaaatgctgttaagggtgtcgaagttgcagatactgagcatcctggccaccccgttcgtgtcttcaaggaagaaaatctggctctccgtgctgccttaattcgcattcggagattgctagatacctatgagtctatggaagacgaggaaatgctggcggagatgcgtaagggtttggtccgtcagatgggacttgtgggtcaatttgatatccattaccaacgtaaggaagaacttttctttcctatcatggagcgctatggacacgattcacctccaaaagttatgtggggagtggatgatcagatcagggaactctttcaaacagctttagcgacagccaagtcactacctgaagtgtcgatttccactgtaaaagatacttttgaagcctttgcgacagagtttgaaagtatgattttcaaggaagaatccatcctcctcatgattctccttgagtcctttactcaggatgactggcttcagattgcggaggagagcgacacctatggttatgccatcatccgtccgtctgagaaatgggtgccagaaagacagagttttgttgaggaaaagattgcagaggagcctattcagctagatacggcag

SEQ ID NO: 69 - DNA, 16944 bp, Streptococcus mitis NCTC 12261 contig15
acactcaaaaccatgtttagcagctgcgactagctcctagttgctcttgatttcatgagtatcaaaagcccgatgtttccatcaggcttcttttttatccatgtacacgtttcatatagtcttggtaactttcggtatccatgagttttttagcgttcttgacgcggtctgctgttggtggtttgaccccttcgagggaatatggaattcccaattcacgccatttaaactcacccatagtgtgataaggcagaatttcaaacttatcaacatttttgagggtcttgacgaacttcccaagttcaatcaagtcgtcatctctatctgtcaatcctggaactagcacatggcgaatccagacaggttttccaatatctgatagatactgggcacaagccaagatatttttattggtttggctagtgacaatcttgtgctgttcttcgttgatttccttgatatccaagagaaccaagtcagtgacagccatgagtttgtcaaacttctcaaggtaacgtggtttattacggaaaggaagggcacaggtatccaaggtacagtggattccttgttccttagccttagtgaagagggcaatcaggaaatcaatctgcaagagggcttctcctccactgactgtaatcccacccttatttccccagaaaccgcggtagcgcaaggcctctgtcaaaacatcatctaccgtccgttcacgcgatttattagactccatagcccaagtgtccgggttgtggcaatactggcaacgcatgtgacagccctgcaaaaagacaataaagcgaataccaggtccatctactgatccaaagctttctgtcgaatgtaccattcctgtcacttgtccataatcaattgtttcttcagacatatcgttaccttccttgaaaacgttttatagttttattatatcacgacttgaaggaaaaacaagatttttgcctattttttagaaagcaatctgtttttcaatttcattttcaattacttatcattttattcttcaaaatcaaagccatacaaggttgcaaagtagtcctcaggtcgctctgcacggcgaatttgacgggctttaccttcttcggtatagaggatttccgcagaacgaagtttggcgttgtactggtaacccattgaaaaaccgtgggcacctgtatcatgaattatcagcaaatcaccgatttctgtatgaggcaattcgcgattcactgcaaatttatcattgttttcacagagtgaaccgaccacatctaccacttcagctggtccttctagatgtgtcagattggtaatatggtggtaggctccgtacatggctggacgcatgaggttgactgccgatgcatccacacctagataggtacggtaggttttcttcttatgggtaactcttgtgaccaaagcaccgtgaggtgctaacataaagcgacccaattcggtgaaaatcttgacttgaccaagacctgctggcgtaaggacctcttcatacaccttacgaactccctcaccaatcaaggcaatatcatttggctcctggtctggacgatagttgacaccaataccgccagaaagattgataaagtctagcgaaatgcccaacttttccttgatttcaacagccaattcaaaaagctgacgagccaactctggataatagagatgggtcacggtattggacgctaggaaggagtgaatcccaaaagtcttagctcctttttccttcaagatggcaaaagcttcaaagagctggtccttggtcatgccaaacttggcttctccaggattgtccataatatctgttcctagctcaaaaacaccaccaggattgtaacgacaagagatgatttctggaatgcctgctgcgcgctctagatgttcaatatcttcaaaggcatccaagttaatggtcgcacccaattcacgcgcataggcatattccttatctggcgtattgtttgaagagaacataatctcagaaccagggaaattcagtttatgactcatcaaaagttctacataactagagcagtccactccacaaccttcctcttgaagaattttcaagatagctggtgttggagtagccttaaccgcaaaatattccttaaagcccttgttccaggaaaatgcttggttgacggcccttgccttctcacgaatccccttctcatcatataagtgaaagggagtcgggaactcggcaacaatcgcttctaagtcttctctattgataaatggtgttttcatatacttccttctattctatttgcaaagaaaggctgggacaagcgttccaacctttagttctatctcttatttatcttcgtcaaagatattaccaacctcaacatcgatggcttggttcttgacatcaatattggttaccttcaagagtgacttgtagtcaaactgcttttcgcgttcttcttgagcattatccgcaaagaccgctacaccagccaattctgaatcaaactcacgcaagagactaatcatcccgttgacagttcctccgcctttcaagaagtcatccacaatcaagacacggctgcctgccttgagactgcgttttgaaaggaacattttctcaatgcggtcaccacttgaacctgatacatagttgacgctaacagttgaaccttcggtaattttcaggtcgcggcgcacaataacaaagggaacattgaggacattggcaactgcatttgcaagaggaacacccttagtcgctacggtcataacggcatcaattttttggtccataaagctcttggcaataatacgaccaatatttttcaagatagctggtgtgctgagcaaatcggacaggtagatgtaaccacctggcaagatacggtcactttctgacaacttggcacgcaagtcttcaaccatttccttggcatcatggcttgagattgatggtgtgaaaatgacaccaccaccagcaccagttactgtctggatatgaccgatttcaatttcctcaaaggcacgtttgataatgacgatatcctctgagatggatgatttagcagattcatacttttcagcaaaagtattgagactagttagtttataaggattattgatcaaatagttggaaatgacaaccatccgatcacttcttcttaatttcatttctatttcccacttcatttaattttgatattttatctattataccatattcacataaaaaaacgaacattcttatcctaaaaatgctcgtttttcttaaattattaatctaaatctggtttatagaaggaacgattgtccatagcgaagattttattggtcatctctcctttatccaccaaagccagagctgttgacatcatcatcatgcttgcatccagattatcaatcatatggataatctctgcttccataatgcgtggacggactggacttccatactcaagcaagccgtggtgactaaggatgacgtgacgaagcagaacgacttcttccttggtatcatcgataccgagttccataactgtcttggtaatttcgctatcaatcaaagcaatatgcccaagaagattgcctcgcactgtgtactcggtctggtctggtcccgtcaactcgatgaccttagccaagtcatgcagcataatccccgcatagagcaggctcttattgagctgaggataaacttcgctaatagcatctgccaaacgcaccatggtcgccgtatgataggccaaacccgtttcaaaggcatggtgattagtcttggcagctggataggagtagaattccttatcatacttggtgtagagctttcggacaattcgttgccagacaggattttcaattttaaaaatcatttgcgacatgtagtcacggatttccttgacatcaactggtgacttgaccttgaaatcagctgggtcattgggttcaccaggttgaggcaggcgaagggtaatttgattgacttgaggggtgttgttataaacttctcggcgtcctttcatgtggacaaccttacctgcagtataggcctcaacgttatgaggttgggcatcccagagtttcccttcaatctcgccactatcatcttggaaggtaaaggctaggtagtttttcccagctcgagtttgcctcagatcagctgacttgattaggtaaaaaccttcaaacagctcatcttttttcatgtgactaatcttcatattcttcctcattttcttggaaatggagtagatcaagcgcaggctcatcttctgacaactcaatgtgacggagcgtccgctcgatagctatggtacgacggtttaatagttcatcaatattgccagaggcatgttggaggtgtttttgtgccttgaccagaatgccaccaaacttgccaaactcggtcttaacgctagcaagggtcttgctgatatggtcggcactcttttggatattgagagtcttgaagccaactgatagggaattgaggagggctgacagggtacttggacctgcgacaataatctgttcctcccgtctcaaatcatcaaagaaaaccggattgcggacaatttctgagtagagaccttctgttggaacaaacaagactccaaaattggttgtccgaggcggtgctagatacttattcctgatatccttagcaaagcgcttgacgcttgctaaaagcgatttacgacagcgttcaatctcgtccttatcacctgcttcataggcttcttctagacggtaataatctgccagtggaaacttagagtcaattggtaggtagacgtattcctggtcgccttgtccgggcaacttgatggcatactccactcgttcactagagttttcaaccgttgcaaattctctttcgtactgggcaggtgtcatgatgtcttcgatgatttgccccagttgcaattctccaagaatccctcgcgttttggttccagagagaaccttgttaagggcgccgacatcacgggcaactgtctgcatttctcccaggccacgattgaccgactccagttgtttggaaactgtctcaaaggaagcctgcaagcgtgtctgtaaggtcttttctagtttttcctcgactgtttggcgcatttgttccaagcgttgctcatttgattcctgcaaggcttggagacgttggtcagtcttgtctctggtttggaggagattatctgtcatttcttgacgaacctgagtcagaccttggtgcaattcaattctcacttcttgcaaacggtcactgacagacacttccaaatctttttgatctaactggctggcttgtcttgcttgttcaaagcggtaatccaactggtctgacaagtgatctgcctgatcctccaagatcttacttagatgtttttcctgcttatcctgcctttgccaaatcagaaagataccagctaggttggcaatcaataatagaacaagtaaactttccatcctacctcctgtccttgctatgcagtacgaccacataaccatctgggcaagtcaccgaaacttccctatctatatattcgttagaagcgtacacttttttaaagaaaaaattctcctctgtcaactcatacttagctccgagaatagtcagctggctatcccgaactggcataaaggctagatagtcgtagtctgaacggggttctagctgactggtcccttctggacaataggcaatcaaattttgcccatcctcaatttctatctggcgcatatagggcgccaacttaggattgctaggtagaaagacgttagctagcatatgatcaatacgaccacccaaagcaccgaaaatagtaacctgagcctgagaattttgctcaaagatggttaagagagccaattccagatctgtatcatctttttctggtcgggcttgaacaaaatgctgggcacgtttttgaatcacctgtcgctcttctgcagtaacagaatcaaaatccccaactgctagagcaagaggcagcttttcttccaagacccagagcgagcctcgatccacaccgacaaagcaatcaaagtctgtccgataatgaccgcggtctccgcctgcaaaaacggcaaccctagtccagttgttttctgagagtttgtactcgctcattgacatctcccttaaagacataggaacctgctacaaaaacggtcgcaccagcttctttagcttgggcaatagtttggtcatcaatcccaccatccacttcaatctcaaagttcaaacctttttcctcacgaagggcaaccaactcacggaccttatccatggtctctggtagaaaggcttgcccaccaaagcctgggttaactgtcatgactaagacttggtcaactaggtgaagcacgtgcttgatggcttcaactggtgtgccaggattgataacaactgaaggcttaactccgagtgaacgaattttttggagggcaccatgaatatggggcgttgcttccacatggatactgatgatatccgcacctgcacgcgcaaagtcttctaaatgatgctctggattagctaccatcaagtggcagtcgaagaccatcttactatgaggacgaagagcttcaaccacacctgcaccaaaactgatttgcgggacaaaatggccatccatgatatcgatatgggcatactctgccccagttgcttctagacgtttgatttcacgttcaaagttggcataatctgctgccagaattgacggagcaatcttgtattgagacataggtttctccttattttggaatttttttgctgacttttttataggtttctctgcgattttcaatctcactgaggaattgcaggtagttgtcaaaacggaagggcgcaatggtaccttcttcaactgctggcttaaccgcacaagaaggctcatgggtatgggtacaagtacggaatttgcagtctcgactgacagtggcaatctctgggaaggcctgattgaggtcttccgccgttgatacttcataatccaaggatgaaaaacctggtgtgtctgcgattttacccccattgagattataaaaactaactgctcgagtagtgtggcgcccgcgacccagactgtctgaaatttctcctgtttcaagattgaggtctggtgcgattttattgagaagagttgacttcccaacacctgtctgccccataaagaccgtaaccttgcctgttaataaaggcaggagtgcctctttactggtcacaaagtcgtagccgatattaccataagtctgttcataaaaatccagttcttctctatcttccaacaaatccattttagaaatataaacgatgggatggattcccttgtgttccaaaagaaccaagaaacgatccagcaaattgctgttaaaatcaggttccttgacggacatgattactacagcttggtcaatattgacaatgggcggacggactaggctatttttgcgttcgtgaatcttgaggatatagccttctgaattttcttcggcagaaaagtcgacccagtccccaacgtaaggggtatgaccttttttacggaaatttccacgcgctcgtgtttgatacaccttgccctcactttctacatagtagaaccccgccaaggctttaatgatttgtccctgcatcttagagtccttgccctttaagtgcgtctgctaggctagcaaactctgccaagctgagagcttccccacgtacacttggtgacaagcctgcttgatccaaagccttggtcagcttgtccttaacctcttcagtcttgccaaagtaacctgtcaagttattccacaaggtcttgcggcgatgggtaaaactagccttggaaaccttaaagaagaagttctcgtcttccactgctacggctggctctggacgacgcaccattttcaagatggccgaatccacatttggcgctggcacaaagaccgtacgaggcacgataaaggcaaccttagctgtcatatagtattgaacagcgattgacaagctgccatatgccttagtgttaggctgggctgaaatgcggtccgccacttctttttgcatcatgacgacaaactcactaaacggaatgccactttcaatcaagtgcatgagaataggtgtcgtgatgtagtatggtaagttagctactaccttgattggcaggtcaggatttttaaaattctggatatgttgcgccaaattaaccttgagaatatcctcgttgactacggtcacattgtcaaaatcacgcaaggtatctgccaaaataggcaccaaacggtggtcgatctcaaaggccataacttctgctgcacgctcagccaaaaactccgtcaaggcaccaatccctggcccgatttcgatgacattaacctggtcatcaatctcagccgtatccacgattttttgaagaatattggtatccgtcaagaaattttgcccgaaggactttttaaaggtaaaaccgtgacgctccagcactgccttggtcacgctgtaatctgcaattctcatctattctcttttctattatctgttacttctattgtaacacattccccttacatttggggtctgcttagctgttctcataagatttcatagcttcttccacttctgccaaggtaaccccaaacaactctaggcgtttgaggagttgcttgccgttggaatagccaattcggagagcctctcctagatattctcgtcgcttacggctgtctgcccctgctagaaaaccaaggcgaatcaagtcgctacgactgatatcaaactgactctcatgttcaaattgttctgtaatctgagctagagccattttcaggtcttcatagctggcatgctcaattcccagagaacggcccttggtcttggacttgggaacagcttcatctcgtttgaggaaggcatgctgaactgttggaatagccgtcataatcatgcgacgaatccgctccccattaaaatctgggtctgtaaagacaatgactccatgaagctcatgtaggcgctgaatacgtgcaatatcttgctcattgatggcagaacctcgtgtctcataggtctctacatcgaaatagcgtttgagattggccgtatcatcgcgcccttcgaccacgataacttgggaaattttttctttcattacttgctgtccaatccaaaaattcgttctgcatttgcagttgttatcgccgctagctcttctgtcgtcataccacgtaagtcggcgataaagtccactacatagcgagtgtaggctgttttattttcacgaccacgtttaggaacaggagccaagtaaggcgcatccgtctccaccaaaatcttgtccaaaggaagttctctagccgcctcttggatgtcggtggccttcttaaaagtcaccactcctgagaaggaaatagtcatgccaagcgcgacaaacttctctgcccactcaagagtccctgaaaatgagtgcataatcccaccacgaggaccaacgccctcacttttgataatctcataggtatcttccagcgcatcacgagtatggacaacaaaaggtaaatccaagtccttagataactgaatctgacggcgaaaaacctgctcctgcacctcttttggcgctgtcatccaatggtagtccaaaccaatctcacctaaagcaacaaccttgggatgcttgagcttatcaagcaagtaggcttcaatctcctccgtgtaagtccctgcttctgtcggatgccaaccaatagtcgcatagagctggtcatactcatctaccaactccaaggcacgctcgaatcggtcggtttatcaaaaccaacaatattcatctgtgtcacacccatctcagcagctaaggcgatttcttctgcctcatgacctgcaaattcttctacattcaagtgtgtatgtgtatcaaaaatcatctcttctaacctcgttttctatcttctattataccaaaaaactgccctctctcctcatctgtacaaaatattctaaaatccatcgtcgtctcttgacgctattttcccaaagcagtataatagcacttattgaaattttcagaaaaggaaaatacaatgtttacaaaattaaaacagacctttatcggtcgtcctcttaagtccttaacagaaggcgagggaggtctgctgggaaaaatgcaggccttggccatgttgtcaagcgacgctctatcttccattgcctatgggcctgagcaagtagtcctcgtcttggctagtctctctcctcttgcgatatggtggagtcttcctatcggcctctttgtcctcctactcctagctagcctgaccgtctcctaccgtcaaatcatccatgcctaccctcaaggaggaggggcctatatggttactcgagaaaatctatctcccgaacttggcttaattgctggaggtagtctgctggttgactacatgctgactgtggcggtatcggtgtcatctggagccgatgctatcacagcagctctccctgctctccacccttacaacctccacatttccatttttctagtttgtttgcttatgctcttgaatttacggggcttaaaagaatctgccagttcactgatgattcctgtctatctctttatcatcagtactgtctttctcttgctctatggaatctttcaactagtaactggttctctcagctatcaggcaacttctcctatcgggcatgctgtaccgagtctgtctatcgttctcattctaagagcctttaccagtggttctgcctctctgacaggggttgaagctatttcaaatgccgttccctttttcaaggctccgaaagaaaagaatgcagctcagaccttgaccatcatgtcactgattttaggttttctgtttgctggtattaccttcctaaactactggatgggaattatgccgcaacacggagaaaccatcctctcacagatggctcaaggtatccttggtaattccttcttaggccaccttggctattataccttccaattctccacagccttaattttggccgtagctgcaaataccggcttttcggccttccctatgctagcttacaatatggctaaaaacaaatacatgccccatctctttatggaaaaaggagaccgcctaggctactctaatggaattttaactctggcatttggggctatgattcttcttctcatttttaatggcaataccgaacgtttgattcccctttatactatcggggtcttcgttcccttcgccctatctcagactgggatgattcgccattggaaaaaagaaaaagggacaaatttcttaaaacctgcccttgccaatatccttggagccatcatttgctacgctatcgtgctgatcctgctctttttccgtctcagtgatatctggcctttcttcccgattattctcgtactcaccctacttttcttggccattcacagtcattaccaaaaagtggcccaacaactacgtctctatgaaggcatcgaaaaacgtacctacgatggcaatcttgtcctcgtcctagtaggaaatgtcacccgagttagcgtcggagccattaactacgctcaaagtatcggtgatgaagtcttagccatgcacatttctactaaggaaacagcagagaaagaccaagaaattctccaagaatttgccgattacttcccaaccattactctgaagaacatcaagaccagctaccgcgacatcatcacccctactgtcaagtatgtcaaacgaatctctgaggatgcccagaaaaagaactatacagtcactgtcctggtaccccagtttatccctaataaaccttggcaaaatatcctgcacaatcagatgagtcttaaactcaaatacgcccttcgttggcaccaagacgtcgttgtcgctagctactcttatcacttaaaagaataaagaaaaggccctaccagaagcaagaagcgtctggtaaggcctttttctgaattcagccactatgcttatactcaatgaaaatcaaagagcaaactaggaagctagccgcaggctgctcaaagcactactttgaggtcgtagatgaaactgacgaagtcagctcaaaacactgttttgaggttgcagatagaactgacgaagtcagtaaccatatatacggtaaggcaacgctgacgtggtttgaagagattttcgaagagtattaactgaaaagcatgactaggaatattattgaatatggttagctaaatcttcctgagcttttttatttgactcagctttttctttcagccatttttcatagagttcttgatactgtttagcagtgactggctctttttgcaattcaacatatttgtagttgtcagcatttcccttatgaccaacgaatgagaatgggcctgtaaacggtacagtcttacggaagattgggttagctccaccactttgaactggtaggaagagggcactatctgtcaaccaagcttgggcttcagcatatttttcatagcgagcttgagtatctgtgatttccgcatcagcctgatccaagagtttcttgtagtcagaaagaccaatcttgttcttgacttccttgtcttttccttcagacaagcccatgtttttcaactgagaacctgtctctggatcaagaatagctaggtaagtcttaggatctgagtagtctccaccccatcctgagatgtcgatatcgtagtctttttgttctgctgtatctgcaaagtaggttgcctggtctttttcatctggagaaagttggataacatcgataactacattctccttaccaagagtttcttctactgtttgtttgaaagagccagcctgttgcacatctaatttggcagtctggtcaactggcatatccaaatgaattgggaaggttactccttgagcttgcagactttctttggccttggcaaacttctctttggccttttcaggattcaagaaggcttgcttaccatcgtttaggttgatatttgcccaatctttaccgtagttgacaattttctcattgacaatgtcaccgaagttcttatcaccaacttgaacaaagttacttggtgtaatcgtattacgcaagatacggtctgctccatcttcaccatttgtctgcgctgcataggcatgacggtcaaaggcaaagttgatagcctgacggaaatctttattttgcatagctgcgcgtgaatccgtcttttccttatcagactgtttcatagtctgcttgtagctttgacgattcacgttgaaaagataatagaaagtaactgagttttgcggtgtgtaggtaatcttgtcctcattccccttcttgagttcagcaaagactgaacttgttgggaagatacggccatctgtatagttaccatccaagaaacctctagcaatgctgtcttggtcagaaccgtcaaagaaagagagtttcactttctcgattttaacattgtccttatcccagtaattagggtttttgtcaagttcaatcaaagatttggatgtgaatgatttaaataagtaaggaccatttgacaagatacttgatggtgtcacacttccaaagtcatctccctgagacttcaagaaggcttcatttacaggactaaggatacttgctgttgttttagagttccaataagtctcaggttggttgagagtgtattgtagcgtgtaatcatccactgccttaacaccaacagttgcaaaatcagatgatttcccttcaacatagtctgctagtcccttgatagagtcttgaaccaagtacaagttctcagcttttttatcagccgcatacttgagaccagtcacaaaatcatgagccgtcacatccgcatactcttctccttcagaagtgtaccatttagctccctgacggattttataagtgtaagtcaaaccatcttttgacacggtccatgactcagccatagaggggatgagattgccatactggtcattttccaacaaaccatcaaccaagttggttgtgatactagatgtagagtctcgtgtagaggtaatgtaatccaaggtatcagggttgctgacaaagatataagagtatgtcttgtcagcattgcttgattgagatgacccgcatgccgctagagctagacctgctgtcaaagccatagctccaaaaagcataacttttgatttcttcatgattattctccattttttacagtatgtgaaatattatacactatttgagcaaaaatataaagcctttttgaacttttttacaaaaataaaaatcagtagactcgagttcctactgatttttgttatggttcgtttggattatgcagccaaaactttgcgtcctttacgacgacgagctgccaatacgcgacgaccgtttttagttgacatacggttacggaatccgtgtttgcgcgcacgacgaagtttacttggttgataagtacgtttcacgatgaatacctcctcatagattttgtattcgtttagccggctataaagtgatcagttactaaacatactttactattctatctgattctttcacttttgtcaatagctctaggcaaatgtttccagctttttcgaatgtaagccctatctacgatactgtttcaagaaacgagtcatcttttcttggatttgggctagttcatcaacacgaggaaggtaaacgatacggaagtggtctggttcctgccagttaaagcctcgaccatgaaccaagagaaccttttcctgcttcaagaaatcaaggacaaactgttcatcatcatcgatacggtacatattgcggtcgattttagggaagatatagagtccagccttgggtttaacggcagacaaacctggaatatcttgaatggcattgtagatgaagtttctttgctcgtaaattcgtccacctggaaggagcaattcatcaactgattggtgaccacccaaggaagtttgtacgacttgttgggccaaaacgttagagcaaagacgcatattggacagcatattgagcccttcgatatagcctttaacatgtgtcttaggtccagacaagaccatccaacctacacggaagccagcaatacggtgggattttgataaaccattcatgctgacacagaagacatctggtgccaagctcgccacaggcgtatgcacgtgtccatccatgaccatgcggtcgtaaatttcatccgcaaagataatcaaatcgttttgacgggcaatctcaataatttccagcaagagttctttaggataaagggctccagttgggttgtttggattgataaggacgattgccttggtattggaagtgatttttgacttgatatcgtcaatatctgggtaccattctgcaacttcatcacagatatagtgaacggcatttcctccagctaggctgacagccgctgtccaaagaggatagtctggcattggcaccaagacctcgtctccattgtccaaaagcccctgcatggacatgacaatcaactcactaacaccatttccaagataaatatcatcaatatctacatttgggaatttcttcagttgacaatactgcataatagccttacgggctgagaaaatccccttggagtcagaatatccttcactatcacgtgcattcataatcaaatcatgaatgacctcgtctggcgctgtaaagccaaattctgctggatttcctgtattcagacgtaaaatcttttctccgtttgctcgcatccgcatggcttcttccaaaacaggaccacggatatcataagcaacatgctctaacttactagacttgttatattctttcatcttgtttcctcaattcatcgagatagtaacattataccactagaaagggattgcgacaagtttactgaaatgtgttattaaaatcctacagaagaaaaacctcactaagagcgaggtcaagacaggggagatagcaggtgttttgacaaaaaaacatcacataccaaaagataagcctagaaaaagcaagcctaaaaaggagtcataaagaagattgaacatgaggaaaagtccccatatcatcaagtaatcccaacgcccacttcgtttagcgactaggaataataccaaatggtagagtaaatgaaagactaaaaagccaacaaaacctggatagagaagcggaattagcttctctaattgccagatcatgataacttctagcaagactgaaactaggatgattccataataaaggaaatttgaattttttgtttcttgaaaagcgtttttcatcattctccctcccttcacttctttcctgctatcctttcttttattttatcatatatttatatagattttaatcgctaacattcttttgaaaaatactttttttgctttacttctatagtgaaaaggtttacaattatagtaagaaaatttcaggaggtttcattatggcacaacgttaccaaaatatcatggtcgcaatcgatggttctaaagaagcggacttggcttttgtcaagggagttcattctgctctacgaaacgacgctaaactcaccatcgcccatgtcattgacacacgcgcactccaaagcgtatccacctttgatgctgaagtttacgaagaactccaagtcgacgctgaaagtttgatgaaagagtacgaaaaacgtgctaaagatgctggtgtggcagatgttcatatcgtcattgaaatgggaaatccaaagaccctactagcgcgtaccattcccgatgctgaagaagtggacctcatccttgttggcgcaactggcctcaacgcctttgaacgcctcttggtcggttcttcatctgaatacattctccgccatgctaaggtcgatttgctggttgtgagagaacaagagaaaactttgtaataacgaagaaaaggagctagaagctcctttttgtttactgtttatacttcaaaccacgtcaacgtcgccttgccatatatat

SEQ ID NO: 70 - DNA, 112411 bp, Streptococcus mitis NCTC 12261 contig16
gggctcccggttttggagtaacttcagacaagataccgagtgatttgctggatttggtggatggtcttcattttcacacctaccatttcccatagcaaccgacatcccaacgcctgccagcatttcaagatcgttatcggagtcaccaaaggccatgacttggttgaggtcaaagccatattcttttccaactcggcgaataccttccaatttagagtttccttgattgatgacatccgctgcaaaaggattgctacgtgtcaatttcaaatcttcaaaatcagctgccgccttctcagattcttctggcgtcatcagcatcaaaacttggtagataggctgattgatcagatgaagcagatcttcttccttttggggaacaaccttgctgaccatacgattaaaggaatgactcaccgtccgagttaaaacagagggaacgaagcgactgattcgttgggaaaaagaacccaaaccaaaggacatgattttagaacctaacatggcatccttggtccctagagcaatctccttaccctcttttttagcataagtaatgagctggcgcaaatgtaacttggaaatagggctcgtaaacaagactctgtctttattaaagatatactggccattgtaagttaccgcaaagtccagatccaaatcgtccatcaattccttaacaaaaaaaggtcctcgacctgtcgctacgccgacaagtaccccttgctctttgacgattttaatcgcgtccttagtggatttcaaaacactcttgtgatcgttgaccaaggttccatcgatatcaaaaaaaacagctttgacttccatcctatcccaatctccccttttgtgatacaatgattataccacatttcagaaagagtgagtaaatcatgcctaagaaaatccttgttttacatacgggtggaactatttccatgcaggccgatgcttctggcgctgttgtgacgagttcagataatcccatgaaccatgtgtccaacccacttgaaggaatccaagtccacgccttagacttttttaacctgccaagcccccatatcaaacccaagcatatgctagccctctaccagaaaattaaagaggaagctgctaactacgatggagtggtaatcacacacgggaccgatactttagaggaaacagcctatttccttgataccatggaagttccccatatgcctatcgttctaacaggggccatgcgtagctctaacgaactcggcagcgacggtgtttataactatctgagtgctttacgggtggctagcgatgacagggctgctgacaaaggggttttggttgttatgaacgatgaaatccatgctgccaagtatgttaccaaaacgcatacgaccaacgtcggcaccttccagaccccaacacatgggccacttggtctgattacgaagcgggaaatcctctacttcaaaacagctgaacctcgtgttcgctttgaccttgatcacatacaaggcttagtccctatcatctcggcttatgcaggtatgacagatgagctgattgatatgctggatttggaacaattggacggcttgattatccaagccttcggagctggtaatattcccaaagaaacggctcaaaaattagaaaaccttctgcaaaaaggaatcccagtcgccctggtatcacgatgctttaacggtatagcggaacctgtttatgcctaccaaggtggaggcgtacagttgcaaaaatcaggcgttttctttgttaaagaactcaatgcccaaaaagcccgtttgaaactcctcattgccctcaatgccggactaagaggacaggctttgaaagactatatggaagggtaagtctcttctccagaaagcaaaatcaggaaatctgcacgattccctgattttttctatttccgttttcgtgttgagcgacgttctgtcaaaccatgaggtaagagaacttcacgttcttccaactcttccttgtgcataatcttggtcaacatacgcatactgatggccccaaggtcataaagaggttgggcaatagttgtcaagtttggacgggtaaagcgtgagatttgtgaatcatcactagtaatgatttcaaattcttctggtactgatacacccttatcagcaaggccgttcaagacacctgctgccagctcatcacctgttacaactgctgcagttgcgtttgatgaaatcaagcgttctgccaaggcataaccatcttcataagtgtatttagactcaaataccaatccttcgctataagaaatacctgcttttttcaaggcttccttgtagccaaccaaacgaaccttaccattgatatcatccactagtggaccgcttacgaaagcaatgcgctcattttctttagcaaggtaggtcactgcatcaatcgtagcttgtttgtagtcaatattaacacttggaagttggtgttctacatccacagttcctgcaagaacaactggtgttcgagaacgagaaaactctgaacgaattttttcagtcaagtggtaccccataaagatgataccatccacttgcttagaaaacagggtattgacaactgaaacttccttatcatcatcctcatcactattagcaagaacgatattatacttgtacatttcagcaatatcatcaatccctttggcaagcgttgagaaataaccattggtaatatttggtatcaccacaccgacagtggttgtctttttacttgcaagaccacgcgccactgcatttggacggtaatccaaacggtcaatcacctcaagcacttttttacgagtattctcttttacattcttattgccattgactacacggctaactgtcgccattgaaactcctgcttcacgggcgacatcataaatcgttactgtatcgtctgtattcattccatttcctttctatatcatacctcacgagactctaaaaaagagacggtatgaaaatttcgttttcatgattctacttattccattttatcactatttgtaaacactttcaagctttttttgaagattatttgaaaaaatttcataggaagctatgtttatgaagaaaaaatcaccttttcttgatttttaatcctatttgctgtatgataagggaaaagaaaggggggcagaaatatggcttttaccaatacccacatgcggtcggctagttttggcattgtaaccagcttacctgatgatgtcattgactctttttggtatatcatcgaccacttcttaaaaaatgtctttgaattggaagaagaactcgaatttcaattgcttaataaccaaggcaaaattaccttccacttctcaagtcaacacctccctacagccattgattttgactttaaccatcctttcgaccctctttatcccccgagagttctggttttagacatggatggtagagagactattctcctcccagaagaaaatgacctattttaatactcaatgaaaatcaaagagcaaactaggaagctagccgcaggctgctcaaaacactgttttgattttgcagatggaagctgacgtggtttgaagagattttcgaagagtataaaaactctagccttcagttgcaagtgactgaaaactagagttttttctattttttcaaagcattatacaagttacggataggttgctttaatgtcggatggataaaatgaggcgcaatttcttgtagagattcaaggacaaaaaggcgttccgctatgtaaggatgaggcaatatgaggtcggctgtataaaggatctggtcctccacaaagagcaagtccaaatcaatcaaacgaggtccccaatgcacttctctcacccgtcccatctctgactcaatggctaacaagctttctaacaagaccggtgctggtagccaggtttccacctcaaccacttgattagcaaagctatcctgctccactccaccccaaggctccgtcgttaagacactggactctttaagaatatggatgccacgagctcgcagtttgtcaatggcttgctccaagtttgcttgtttatctcccatattgcttcctagagcgataaaggctcgttgcttgcggcgatgaatggttaccgagcaagtatctagtggcaaatgaaccggcgcccaaggttttttcagttccagcttgatttcttggacaagaggataagtttcaaaggtacgttctaccagtttgtaggctaccgtttcaatcaagtcctcagttgtttcctgaaaccaagtcgtccactgctgacacagttctccataatggacagaggctgttaaatccaagtctgtagccgccttggtcatatcataggataggattgcggaaataacaaacttctgccctaattccttttcactaggaaaaagaccatgataggcaaaaatttccaaatccttaatctgcagttgatccataatgattcctttctagaaaaatccgcccaaagcggattctttttatagtcccattaaacgataagcctggtctcggaggtccttatctgtttcaaatagaccacgagctactgtcgtcaaggttgcagtgcctggttttctgacaccacgcatgctcatacacatatgttccgcctcaatgacaacaaaggctcctttagcacctagatagtccatcaaggcatcggccacttcgatattcaaacgttcttgaatttgtggttttttcgaataaacttcaaccgtacgggctagcttagacaaacctgctacacggccatctggaatataggcaatatgcgctctaccataaaatggcaagaagtggtgttcacacatagtatggaaaaagatatccttttctaccaccatattatcgtcgataatctcaaaggattttgacaaatgttcctccgctgtttgaccaagccctgaaaaaatctcttggtacatacgggccacacgagcaggcgtttcctgcaagccctcacggttagcgtcctctccgacagcctcgataatcatttttacagctgtttcaatcttttgtgtatccattttcgttcttcctctccatcagataagctctcacttggctcaagaaatacaatgaacctgtgacaatcctaactgtttgtttctcttcttttttatctgtcaatttctgctctagaaaatcctgccaaccttggtagctgagatttctagacttagctgcctctttcagcacgttttcatcagtcgcccgactatcgtcaaaatgtgtcagagtaagctcggtatctggcatggcccccagcaagtccaacatatcctccaaggccttggttttgatacaagtaaagaggatttccttacgataatctgcaaaacgttcttgcaaggttgctaataaagccttaatagcatggggattgtgggctccatccaaaatcatcaagggatctcttgacacgatttccaaacgccctggccaacttgtttcttccaaggcttgagcaagcaagtgattgcttgctagttctcgaccatcttcttgacaaaaagtatcaagtaaagctatggccatcccagcattctctatctggtgcaaaccaagcaggccagtctggaagtgaccttgtctgagagagctagtataatcaaagacttcccctgtcatcacactcttttgatgaccaacctgataatctgccccgtaggcaagtctcggcgcatctttcccttccgcagtgtggtcaatcacagccaaagcttctggagcaatgcgacctgtcaccaagggaataccttgtttgataataccagctttctgctctgctatggcttccaaggtgtcacctaaaagggctacatggtccaatccaatagtcgtgatgcctgttagaataggctggcagacattggtactatccaagagtccacccatgcccacttccatgatagccacatctacttgctctgaggcaaagtagtcataggctatggctgtgataatctcaaactcggttgtgccctgtaaattagcgaccgcttctccctccagcaaagactgatagtctgccatgagggtttctagcttcgcttctgggatagattccccattgatgctaatctggtctgtataatgaatgagatagggcgagctgaacaccccaactctcagccctagcttttctagcatatttttcaaaaaagcaatggtagaccccttgccattggtccctccgatatggatgaccttaagtttgagatggggattgccacgcaaagctaacagttccaccattcgttccaagccaaaatgcggttggtccgtccggtagttagtaatccactgattgttttcaatttctttcatcttatttgtattgttttaaatctagattttccgcttcatcagccagacgaatagcggaggcaatttcaaccgccatcctgtgactagctacgtcatgcactcgtaccacttccacaccctgtcgcgcagcgatactagttacatgagccgaagccgtatctcgattacggaaaccaggttctgtctcaggattgacttcaaaaccattttcttcaaggatattgatgacaaaccgcttgcgcgatactccgagaaagattggataccccttctgatttagtttatccaggtcacgtaaaagaagcagattttctttcttggtcagaccaaagccaattcctggatccaacaggatattctcttgtgcaatcccagcttcctctgctctcgctaaggctctgtaaaagaaagcctccatcaagtcttcgattggcaatttttcaaagccatctaactcctccactgtaaaagcctgaccaaagccaaaatgaggaaatatgagcgagctaggatgctgaggtcgagccataacgggattaaacatgatgatcaccttcgctccagccttagcaaccacataggccattttttcatcacccatgagaccagtaatatcattgactagattggcaccagcagccaaagcagcctctgctacctgacttttccaagtatcaatggagataaggacatcactttccttgcgaatagctttaatcactggaacaacacgctggatttcctcttctatctcaacatagctacttcccggccgagtcgattctccgccgatatctagcatgctggctccttccgctatcaatttacgagcctgctggagcgcctgctcaagagcaaaaaattgaccaccatccgaaaaggagtctggggttacattgataattccgcaaatagctgtctttgcatgattggttttacttgacatatcggtcactccctcaaggcttttcaccatattatttctctattttaccataaaaagaaaaagatggacacgattgcattcatctttttcccagtagaaacaagtaagcaattgtcaaaaatcttaaacagaaatccctaatgtccgactcaaaatcaccacgagagccaacaaacagaaaacaaccccattaacaatcatgtgaagtaagatagacatttccaaacgttgggtcttgtaagccgtccaagatagcactgttgacatacctccatagataagaagggaaggtaaattggtcggtaaatgaagcaaggcaaagataatagcaccgactatataacccacattttctttaccacgaaagagttttttgggaatcactcctcgacataaaatctcctcacagataggagctattagaacgagtaagaaaaaactggaaatcaaggaactattctggaccagatcattaatgtttgattgattgctggttgttgtttcattcctcaaatgtaacaataatacacccgaaatattactaataagaatgactaaataacttacggccaatctaaccaagtcctttaccttaaaaaacgataaactaaaactagccaactgtgattttctagcacctatgataaatacagttaaaaccacaagagataagattcctactaatagtccagtttgaagcagtggaaattttctgctagttagaaaagttgctagagccaaaggaaactgagaaaataaaagccctactagaaagattattagccacttccccctgtttaatacttcactccaaatattcttttttatcatcgatcatcctcctatcatttaatcaaaatcacctacttagtttaaagcaattttcaagtaactataatataaaagggggagaccccctttttatattatagcatttatagtgccatactaatgtagttaaggataaacaaggcatccaaaatccaaatcattacatgaacatctttagcttgacctttgacaagcttagtcaaggtataagtcaagaaaccaactgcaatcccttgagtgatagagtagctgaatcccataaagatagatgtgaagaaagcaggaaccgcttcagccatatcatcccaatggatatttttcaagctagccaacatcataatcccaacgataatcaagattggagctgtagcagctgttggtacgatcgctagaagtgggctaaagaagcttgaaattgcaaaacagattgccacaaccaaggctgtcaaacctgtacgtccacctgcaccaataccagcagcagactcaacataagtcgttacgtttgaagtaccggcgatggcaccaattgaagtaccaatcaagtctgaataaagagccttgtccaacttagctgattggtgattttcaccatttgtcgctacgataccaactttttcacctgtaccgatcaaggtaccaattgtatcaaaaatatctgtcaatgaaaaggcaagaatagccatcagagtttcaggcaagcgagctgtatctgaaatcaaagctcccaaaccttctgaaccaagagctgcaccaaaaactgtcttcaagtcttcaaaggctgcaccaacatggttattagcaaaatcgatactagacaaatctaccaaaccaactgcaatagcaagaatagttgttgtcaagatagaaaggataattccccctttaatccctttaatgacaaagaagatagtaatggcaagtcctgcaagagccaccaaaacagctggattattaaagctgaccaagcctggaactgctgaagagtttgctgcaatcgttgcttgagctttgtcagccccttctcctacaacaatatagttgcctggatcaatcgtaaatttcaaaagtccagcattcttaattcccacgtaggcaaggaagacaccgataccagctgaaatagctgagcgaagggcatttggaatcgattcaatgatcattttacgaacatttgtcaaagtgataatcaatgagataattccacagatgaagaccatagctagggcttcttgccaagaataaccgagtccaaatacaactgtaaaggtaaagaaggcattaagtcccatacctggcgcttgggcataaggtaagttagcgtagaaagccatcatcaaggtaccagctactgcaccgataatcgttgcgaggaatacaccctgagcaggcattcctgtttgcgaaagaatttgtgggtttacaaagagaatataactcattgcaaagaaagttgttaaaccagcgagaacctctgtacgaacgtctgtaccgttctcttttagtttaaataatttgtccattatcaatctccttttaatttttacgaacaataatagaattatatcatttatcattcactttttcaacatctttgtttgatttatttaagaaattgatctaatttcattttttgtttggaatctgcttttctgcctgctttctgttataatagaaaacatcttatctgaaaagacactagaaaggtccctatgacgaaaaaaattattgcagttgacctggatggcaccctgctcaactcagacagtcaaatttctgactttaccaaaaaaaccaattaaaaaagttgctgaaaaaggccatcaggttattattacgacagggcgcccttaccgcatggcaaaagatttttaccatgaactaggcttagacactcctatgattaatttcaacggctccctcactcatttaccagaccaaacttgggactttgaaaagtgtttgactgtagacaaaaaatatctgctagatatggttcgacgttcagaggacattcaagccgattttatcgctggagaatatcgtaaaaaattctacattacaaatcctaatgaagaaattgctaatcccaaactatttggtgtagaagctttccagcctgaagatcaattccagcctgagttggtaaccaaggatcctaactgtattcttttacagaccagagccagtgacaaatatgccttggcaaaagaaatgaacgccttctaccagcatcaactgtctatcaatacctggggaggtccgctcaatatccttgagtgtactccaaaaggagtcaacaaggcctttgctttggactacttgctcaaggtaatgaaccgcgacaaaaaagatttgattgcttttggagatgagcacaatgataccgaaatgctcgcttttgctgggaaaggttatgcaatgaaaaatgccaacccagagctactcccctatgcagatgagcaaatttccttgacaaatgaccaagacggggttgccaaaactctgcaagatttattcttatagttcattctgaccagcttgcaagctggtctttgtgctcttttcacagtctcatcaaccagttaatcaattattctattttttacctccaaaaccttggaaaaggctttcttttgtgatataattcacatataaatacaagagaactcgtcatactcgactctgttgacacaaaatcaatccagtcccgttatccctgttctcggtcaatatcaaggaggatagctatgaaagctgttgttgtaaatccagaaagcactggtgttgctgttgaagaaaaagtactccgtccacttgaaactggggaagcacttgtagaaattgaatactgtggtgtttgccacactgacctccacgttgcccatggtgactttggtcaagtaccaggacgtgtcctaggtcacgaaggtgttggtatcgttaaagaaattgccccagatgtgaaaagccttaaagtcggtgaccgagtcagcgttgcttggttctttgaaggatgtggcacttgcgaatactgtacaactggtcgcgaaaccctttgccgtacagtgaaaaatgctggctactcagtagatggtggtatggctgaacaatgtatcgtaactgcagactatgctgtcaaagttcctgacggacttgatccagcccaagcctcttctatcacatgtgctggtgtaacaacctataaagccattaaagaagccaaagttgaaccaggccaatgggttgttctttacggcgctggtggacttggtaacctagctgttcaatacgctaaaaaagtattcaatgctcatgtcatcgcagttgatatcaataacgacaaacttacccttgcaaaagaagtaggtgctgacattgtgattaacggcctcgaagttgaagatgtacctggactcatcaaggaaaaaactgatggtggagctcattcagctgtcgtaactgctgtgtctaaagttgccttcaaccaggctgttgactcagttcgtgctggtggtcgcgtagtcgctgttggtcttccttctgaaatgatggaactcagcatcgtcaaaaccgttctagatggaatccaagtcatcggttctcttgttggaactcgtaaagacttggaagaagccttccaattcggtgcagaaggtttggtagttccagttgttcaaaaacgtccaatagaagatgccgtagcaattttcgacgaaatggaaaaaggtcaaatccaaggacgtatggtactcgacttcacccactaatctaataaaaacctattttaaaagttggaatacgcttccaacttttttatattaaattttttaataaggattcaaaaaaacttctctaaaactcaatatatcaatattttcagatgtaatctttttaattattttatgataaatagttgatttttagatgaaaacggtttatacttaaaaagtcttaaagttttcttaaacgaaaactaaaacaaaaaggaggaatgacaataatgagtatcggaatcattattgcgagtcacggcgaatttgctgcgggtattcatcagtcaggttctatgatctttggtgaacaagaaaaggttcaagttgtaacctttatgccaaatgaaggtcctgatgatctatacgctaagtttaataacgctgttgctgcatttgacgcagaagatgaggttctagttttggctgacctttggagtggatctccatttaaccaagctagtcgcgtgatgggagaaaatcctgagcgtaagtttgccatcatcacaggacttaacttaccgatgttaattcaagcctacacagagcgcctgatggacgctgctgcaggtgtagaaaaagtcgctgctaatattatcaaagaagccaaagatggcatcaaagctcttccagaagagctcaatccagctgaagaagttgcaagtgctacagctactccagttgcccaagctgctatcccagaaggaactgttatcggagatggaaaactcaagattaaccttgcccgtcttgacactcgtctccttcacggtcaggttgcaactgcttggactccagattcaaaagcagaccgcatcatcgttgcttcagataacgttgccaacgacgaccttcgtaaagaattgattaaacaagcagctccaaataatgtcagagctaatgttgttccaattcaaaaattgattgaggtttcaaaagacccacgctttggagaaacacatgcccttatcttgtttgaaacacctcaagatgcccttcgtgcaatcgaaggtggcgtgccaatcaagacccttaacgtaggatcaatggctcactcaacaggtaaaacaatggtcaacaacgttttgtctatggacaaagatgacgttgctacatttgaaaaaatgcgtgacctcggtgttgaatttgacgtacgtaaagtaccaaacgacactaaaaaagatttgtttgacttgattagcaaagccaacgttcaataacaaatatcaaactatagaagaatcctaagaaaatttttcactttattatcattaaatagaaaaggaataaaaccatgtcagatatttcaattatttctgctgtcttggttgtagttgttgccttccttgcaggtcttgaaggtatcctcgaccaattccaattccatcaaccaatcgtcgcatgtacccttatcggacttgcaactggtaacctcgaagcaggggttatgcttggtggatcacttcaaatgatcgcccttggttgggcaaatatcggagctgccgtagctcctgacgctgctcttgcatctgttgccgcagcaatcatcttgatcaaaggtggtaactttactactgaaggtatcgccgttgcaacagcaacagctatccctcttgccgtagctggacttttcttgactatgattgttcgtacaatctcagttggtttggttcacactgcagatgctgctgctaaagaaggaaatattgcggctgttgaacgtgctcactttatcgcacttcttcttcaaggtcttcgtattgctatccctgcagccttccttatcgctatcccagcttctgccgttcaagatgctcttaaattgatgccagaatggttgaacggtggtatggctgtcggtggtgctatggtcgttgccgttggttacgctatggttatcaacatgatggcaactcgtgaagtatggccattcttcgcaatcggttttgcacttgctgcgatttctcaattgactttgattgcccttggtgtagtcggtgttgcccttgccttcatctaccttaacctttcaaaacaaggtggtaacggtggcggcggagctgcgacttctaacgacccaatcggtgatatcctagaagactactagaaaggggaacaatcatgactgaaaaacttcaattatcaaaatcagatcgtaaaaaagtttggtggcgttcacaattccttcaaggttcttggaactacgagcgtatgcaaaacttgggttgggcttattcattgatcccagctatcaaaaaattgtacactactaaagaagaccaagctgctgctcttgagcgtcaccttgaattcttcaatactcacccatacgtagctgctcctatcatgggggttactcttgcacttgaagaagaacgtgcgaacggtgttgaaatcgatgacgctgctatccaaggggttaaaatcggtatgatgggacctcttgctggtatcggtgacccagtattctggtttacagttcgtcctatccttggagctcttggtgcatcacttgctgcatctggtaacttagttgggccacttctcttcttcttcggatggaatgcgatccgtatggccttcctatggtacacacaagagtttggttacaaagctggatctgaaatcactaaagatatgtctggtggtatcttgaaagacatcactaaaggtgcttctatccttggtatgttcatccttgccgtccttgtacaacgttgggtatcgattaacttcactgttaaccttcctggtaaacaattggctgaaggtgcctacatcaaattcccagaaggacctgtatcaggtgctgaattgaaaggtatccttggtcaagcacttggtggattgagcttggatagcgttcaaccacaaaccctgcaaggtcagttaaactcattgattccaggattgatgggacttctccttactttcctttgcatgtggttgcttaagaaaaaagtatcaccaatctcaatcatccttgcactctttgcagtaggtatcgcagctcgtttcttcggtatcatgtaatcttggtgagaatgtacaaacaaaaaaagaatcaggtttatcacctgattcttttggctctttgtcaaatagtgttgatgaagaacctaatgaaaaaagaatccaacaaaaattggactacctgtctccggttgaataccgaagacggtagccctagggtgtttttattaaattctcactttttggggtcagtccctaagcctgatagtaattttttgttcatactattcccctttagtcatttactactttaagttgcattgctttagctacttcttctgcctttgatcccttaggtgtatggatttctacatctgggttacagttatccacaaaatagaagtattctgtaatttctgttacacttgctggaattgtaatagatttaattgatgatgtcccccaaaatactaatgttccaatactctttgttccttctgggaatacaactgattctaatgaactatcagagttgaaaacatcatcttctactgtttctattgacttaccaaagtggacatactttaacttattgtcaatcgtaaacgcaccttttccaatatatcgtactgtatctggtaaaacgattgcctcacaatgtttcaagttcgcaagaccacgttctccaattgcgataacaggtttacctttaatttcctttggtacacgaacaaccttatcgtcagaagtacaactatagatgacataaccttcttcccataaatataagcatgttaatatattaatatatttaaggatttataactatagttccttaattttcccagtaaaaaaacgaaaggcaccacaagttatttatgtgttttctttaaacgattcatgtacttctgtcgcaacttctcacccgcctttaattgcggttgcgatagattgaggacctaaatatgcatcccctgttattagttcatttctattgtattctgatgttgaccgaaagtcaaatttttacctttcatctagaacactaaagtctacttttgttcaattgctgcaacgacaaggtcacatggaataatatgttcactacctgccacttcatgcgttgatcttcttccactttcatctgattcaccaagttccattgtaataacctttacaccagttactttcccactctcatcacgcaatacttctttaatattctctaagaaatggaatgtaacaccttcattgtgtgcatctttgatttgtagtgtagcttctagtatattgttcatatggtcatcattcttttgttttaggtttcagcgcttttaatataatggatgttggcctttttgtatacactaaaatagggttggtggaaaatttccatcaaccctaaaaattatagaaccacacaaaaccctgaccagagatggccagggttttgtatttcaaaaattattctgtaaattctatagttacttttacttcagaatccattgaagaaaatattgttttataataattgattgcagattctttaatttcactcttaaatttatctaaatactctgcttgtttatcactagaaagttggttagcgaccaatttcccagtatcaatatcttctgtagttccacttaataactctccatgactatcatataaatcataaggattatcttttgaaagttcaacaccaattacttccaattttggaacaataaccttatattctttttcgcttatttgttcaacctttacactacttttaattccaaatttagctttataatttaaaattactaatgctgcttttttagagaacggcacatcaaacccaaaaacttgagttgtttttgtttcagaaataatttcattaattcccgcattcaaaaatacaacttcattcactttttcaatactttcgatattaattgacgatttgacttctgatttatgttccttaggtaagaaaaatagcactccaatagctataatagctattaataccacattcaatagtacactaaacatattaactttcttctttaatatagacaagataaaaaaacctcactttaaataatctatctaaattttacacattctaaagaaaatagtcaatattttttcgtactatcttctaaaattaattgtgcctattaaaaatgaaattagtttgttgcatttgattatattttttgaacaccaaatccatttaaaattgagtgctattttgagcactaaaaaagggctctttgtcaaatagtgttgatgaagaaatttaggaagggattaagcaactaattgttgcttaattcctttttgttttgggccaaacatttttgttattaaaataatcctatttctaaaatggtaatagtttctaaagccgtaggcatttcttttaagcacttttattttattgtttattccttcaatagggccatttgttctagttggatactcacaagtattttgaatatatggcaagtaagtcataagagtctttaatactctttttaaaccaggagataggtctaattgcgtagctgcttcaatcgtttccttgaattctatataatctctatcctgtatacattcacgaagtgaatgtacaacctcataatcatttttaagagatggatttttttctaagatataatctacgattcctttacttgttatgaagctttcaaaaagcttataacgattatatttatagttctgaagttcattagagttctttaaaattaacttccaataatgttttaactttcgatataatttagagtctttatagcgatgcttattcatgacacgtacccgagttcgatttaattctctatttaaggcttgtacgatatgaaaaggatcaatgataattttagcgttaggaaacatttcttttattaattgaatgtacggtaagtacatgtcgatggagatagtttttacctttaatctagtcttaggctcaaaacgatgaaaatactttttcaagctgtaagattttctatctcgtacaacatcgaccagcttgtgtgtagtgctatcacaaataatgaagctcatattactatcggaagatttgacggatttaaattcatcaaaacacaaatgctcaggtaaatcgtgtaatggtttaatctttagtaaacgtgttgtatcatctatgatacgtcttaccgtatgaactgaaacatttgtttcttttgcgatataggtttcagatactgtttcacttatttttgatttaatttcgttttttaagcgtttagagatatgacagtgtttttctacgattcgactagtgtctgcggtaaatgaagagccgcattctctacagagaaatctctgcttgcgtagatttaagtaggccgctaggcctgaaacagaacagagagtgatacgagatgttttcgtgccgtttttaacgatattattatttcggctaacacacccacaaacggtacaaaattctggtttatgcgtataagtagctgcataaaataaagattttctctttttaaatatcttctcttgaactttattatcccaaataatgtttttatctttgatttgtagtgtagcttctagtatattgttcatatggtcatcatccttttgttttaggtttcagcgcttttaatataatggatgttggcctttttgtatacactaaaatagggttggtggaaaatttccatcaaccctaaaaattatagaaccgttctttttatatctcatttattcagccaaggcacccattggatcccatggtgcaaggacgattggttctgcttcataggcagcttgttcttctgctgttagtaattccttacgaacaacaatttggtaagtgtactcgtccatccaagcatctgaggcaacaaagtacccatcggtaccgaccttgtctccccatgagttttcaaccttccacttggttgacttcccattttcgtccaaatcaacacctgtcaagaccatagcgtgggtcattaagctttcactatagtccagacgtccagccttgtcttgagtgaattgaatatccatgcttgattcaaagtcataaacatctgtcgcaaggattccagctttacggttgctgagctgaccaacatcagaaccaaaccaaacagtctcacctgcttgcatttgagcaattgccaattctttcaagcgatccatcggcacgttgatgtaacgaaccgcacggctaccaaccacattttcccaacatctcaactgtgtaagaatttgccgtatggtttatcagcagttggagcattgataacagaaacgtagtcttctagaggaagatttacatatttcttgtaaaactcttgtggtgtaatgtccttttcgctttggtagttgttgtctttatcgcgataagcaaagtcaaactgacgtggtggaagacccaatgacatagcaaggaagttaaaaatttcttgcaagaggtcttctttcttagcttgaacagtcgcttggtctgcaccagaagcaagcaagtcacgcaagatttgagcatcttgacgaagcaatttgttgagaatggcatttagttcacggctgctactagatgaaacagactcaggataaacagacttaggtacgacaccgtatttctcaaagagagaaacgaccatatcccactgaccgccatcttgttgtggtgtttggagtagaaatttaaccttacggctcgtcaagtcttggtctgcagtcgcaatgacttgttccaagaaccagtttgatttctcatacttgtcccagaagaaagtgtgggcctgtgacaactcaaagttttctagtttgtattgtgagatgagcttgtggcggaaagtgttaagggctgcaaacatccagcaacgaccagaagccttctggttagttactttgtccttggtcaaatccaatgagaaaacaggggtgttgtctacatggctttggcgacgttctagggctgcaaaaattccgttgtggctggcagcattttcaatcgcttggtattttacatttgcttcatagttggcaaataatttatcagtaaatgattcttgaatcgcgttcatagattcctccttttattctacagtctattataactcttttcacaaaggaagcaactgaaaaacataaaaggcgaggacattctccctcgcctttttcaaatataaaccaaattaagcaatactagcaagaagattttctaattcctccttggtcaagcgacgccattcccctcgttctaagttctcatccaatactagcgttcccatagtcaaacgttgcaagtctactacttccttgccacagtagcccaccatacgcttgacctgatgaaacttcccttctgcaatggtcacacggatttggctttgatttttttctgtatctatggatacaagctccagtctagcgggttgacaggtaaagtctttgagaggaataccctcagcaaatatatccacatctccttgggtcataattcctttgacctgaaccagatacgtcttgttcacatgacgcttaggtgaaagaagagcatgggccagctggccatcattggtcaagagtagaagaccatgtgtatcaatatccaagcgtcctactgggaaaacttccttgctccgagcaatatcatccagcaagtccagaacggttctgtgcttgggatcctcagtcgctgaaataaccccttggggcttgttcatcatgtagtagacaaactcttcatactccaacactttcccatcaaagcgaatctcatctctttcttcatcaatctgcaatttagctgacttttcttttttaccatttaccgtcacgcgaccagccttgagcaagtttttgacctcagttcggctccccacagcgcaggcaactaaaaatttatctaatctcatagaactattatatcatactcaaaaggaggctggtacaatgaccaacctccttttcgtttcatactcttcaaaaatctcttcaaaccgcgtcaacgtcgccttgccgtatagatgttactgacttcgtcagttctatctgcaacctcaaaacagtgttttgagctgacttcgtcagttctatctgcaacctcaaaacagtgttttgagctgacttcgtcagttctatctacaacctcaaaacagtgctttgagcagcctgcggctagtttcctagtttgctctttgattttcattgagtatcagatttaagaaattaacttcctcgtctccagaaaatcgctaagacaatcatggaacctagtactgccggaataatggcagttcctgctattatcggtccccaagtcccaaaaagcaagtgccctataaaggcaccaatccagcctagaaacattttcccaaaacatcccatgcgctctccacgattggttagagtacctgctaaaaatcccactaggagaccaacgaacatacttcctaacatattatctccttaatttgcccaatctccgttacggaagagtggtacacgtgtcccatcctcacggataccatcgatatccatttgactagacccaatcataaagtccacatgaacatctgaacggttaagccctgcagcttcaagctcttcttcgctcatctctgctccaccaacgacgctagtcgcataggctgcaccgatagccaagtggtttgaagcattctcatcaaaaagggtgttgaagaaggtaatgcctgactgagaaattggacttggatctggtaccaaggcacattcacccaaggcacgcgcacccgcattttcaaagacaaggtctttcatgacttgatcgcctttttctgcagcaatatccacaatttgtccatccttgaaggttactttaattccttcgatgatatttccattatagctaagcggttttgtagaagtgacataaccatctgcgcgacggaagtcaggtgctgtgaatacttcctctgtcggcatattcggcaagaatccttcaccctgcgcattgatagcaccagctgattcccaaacgtggttcttcggcaagccaagtgtcaaatcagttcctggtgctgtgtaatgaagggctgaaaattgttctttattaagcatatcagccttactcttgaggatggctgcatgctcttcccaagccttaacaggatctgcttcgtagacacggcaagttttgaagatttggtcccataggagatcaactgcttcttcgtcgctagcagcatttggaaagacttttttagcccactcaagtccagcagcagctgctaccgtccagctgaccttgttggattgcgttgcaatacgcattggcttcatagcaagtcccatagctttagcagaagctgaaagcttgtcagcatccactccgttcaaggcacctggatcagaagaacggacaccaagacggctagccttgttctccaagagatagttcatctcagcaatcttatattctggcacattgtccagacgctccatcggcgcatggagaaatttctcacggttaatcacatcatctgtccactgaacaataacctcatgcgcacccaaggcgtaagcttctttcacaatcaaatgcgccaactcgcgttgctccacatcgatagaaagagccaaagtgtgaccaggttgcacgttgattccattcgcaaccaataatttcgcatatttttctagattttctttaaaatttggtaaaaccattctattcttccttttctatttttatttttctttcaaagcagaaaataatcctgccaaagcaatagcaccagacaaaaatgctgttgatagaagtattgtctggtcagcaagttccaattgatactcaaacaccttctcagccggcttgtcttccgcaaagattcttagtttcatcttttttcctccaagaccttaaaacaactcatcaaacaaactgagctggttatcctctggcatattgcccagaatccccatttcatccatcttttcaaccaaggtagatgagaggccaccgcgtttgcgtagttctgttttggagaggaattctccctcttcacgcgctcgcaccaactgcttagcaacgttctctcccagaccatccattgctacaaatggtggaatgagggtatccccatcgatgaggaactctatcgcctgactacggtagagatcgagtttaccaaacttgaaacctcgttcccacatctcattgacaatctcaagagttgtatagagatcaatttccacattagaagcctcattgttcttccgtttttcagagatttcttccattctgcgcttgatggcatccaagcccgcacccatagtcttgatatcaaaggctttagcacggattgagaagtaagcacagtagtaataaataggatggtgaaccttgaagtaagctacacgcaaggccatcataacgtaggctgccgcatgggctttagggaacatatacttaattttcccacaggattcgatataccactctggcaccttattggccttcatagcttcgatatagccatttctctcctcttcggaaatcttgagccacaagcccttacgtacccgttccatgatggtaaaggccatcttaggttcaagaccagcatgcatgaggtacaccatgatgtcgtcccgacaaccgataacggttgataggtccgctattccttgcttaatcaaatcttgggcattgcccagccaaacgtcagtaccgtgggacagacctgagagctgaagcaactccgcaaaagtcgtcggatgcgtctcatctaccatcccacgtacaaagttggttccaaattctggaatccccagcatgcccgtaggcgttccaatttgttcaggtgttaccccaagcacatccgtcccagaaaagagggccatcacaccttcgtcatccatagggatttcattaggatcaatcccagacaagtcctggagttttcgaatcatagtcggatcatcatgtcccagtacatcaagtttgaggacgttctcgtcgatatcatggaagttaaagtgagtggtctgccattcagcggtcacgtcatccgctggatactgaacaggagtaaaatcgtagacatccatgtagttcggaataacaacaattccccccgggtgttgacctgttgtccgcttgacacccgccgctccttgagcgaggcgttctacctctgcatcacggtaaaactttccatagtcccgctcataacccttgacaaatccataggcagtcttggcagctaccgtaccaaccgttcccgcacggaaggcatattcctcaccaaagatatcacgcacatccaaatgggcgctaggttgatcttctcccgagaagttcaagtcaatatcaggaaccttgtctccatcaaaaccaaggaaggtttcaaacggaatatcctgcccatttttgctgagtttgtgaccacactttgggcagtccttattaggcatatcaaatcctgaaccgtacgaaccatcggtgataaactcactgtattgacattgaccacagacatagtgaggagagagaggattgacctctgtaataccaatcatggtcgcaacaaaactagatcctacagacccacgagaaccaaccaagtagccccgttcattggaacgtagcaccagcatctgcgatgccagataaatcacggcaaatccattccccagaatggaagtcaattctttttcaatccgcaaatcgacaatatctggcagcggatttccataaatctcaaaggccttcttataggtcaactcggcaactgtttcttcagccttgtcgatgaaaggcgtatacaagtcccccttaacaacctcaacaggttcaaagatatctgccaaggcattggtgttttcaataaccaatttccgagctaattcctctcccaagaaggcaaattcatccaacatctcattggttgttcgaaaatgagccttcggaagaggagctggttgggcatgttccccatgaccgatagttcggttaaccatagctccctgtcccaaactacggacaataatttcacggtaaatttcttcttctggttcgatatagtggacatttcccgtagccaaaacgggcttaccaaggcgttctccaacctctatcaaacttttgataatggtctggagttcttccatatccttaacctgctccttggcaatcaagggagcatagatagctggtggcatgacctcgataaagtcataatacttggccacctcaaccgccgcatccacgccctgggaaacgactgcatcaaaaacttcaccttctgcacaggctgagcctaaaatcaagccctcccgatgggcatctagaaccgttctcggaattcgtggcaccccttcaaagtatttggtattggacaaagaaaccaacttaaagatattttttagacctacctgattcttgacataaatggtcgcatgcttgattcgagcttttttataagaatctggactaaccaaatcaatattgagtctagctagatcggtcacaccatgtttttctgctacttctttgataaagatgaaaagcaggcgacctgtagcttccgcatcgtagttggccatgtggtgatgctctaaggccacaccaaaacgcttggtcaaaggccccaaaccatgacgtttatactcaggatagagatttctagcaaactcgagcgtatcaataactggctgactaatctttggcagaccatgacgttcatagttggcattcataaagccaacgtcaaaggtggcattgtgggcgactaggaccgtatccttacaaaattcttggaattcttgcaaaacttgttccagtggcttggcatttttgacatgatcatctgtaattccagtcaactcagtagtaaaagctgacaagggatgcccaggattgataaattcatcaaattcagcaatgacattccccttgtacatcttagaagctgcaacctgaatcaagtcattatagatagctgaaagtcctgtcgtttccacgtcaaagaccacgtaggtcgcttctgacaagtccatctccacttcgttatagacgatagggacacggtcctccacgatattggcttccattccatagattagctggattcccgctttcttagcagccttatagccgtgtgggaaggactggacattcccatggtccgtgatggcaaccgccttgtgtccccacttagcagctgtcgcaacgatttcttcgacctctggcagagcatccatagtcgacatgttagtatgagcatgaaactcaactcgacgctctccttctggcatcaaatccttccgctcatagtgaacaacttcctgcacatcctgtacgttcatagtcaaatcacgtgtgaagttattcatctccacattcccacgaactcggagccaagaatttttcttaattaggtcaaacttctgggcctcttcctcgttcttaacccacttttgcatagaaaaacttgaagtgtagtcagtcattttaaagttgatcaaaacacgccctgttctggtcactttttgctccacatcaaaaacaaccccttcaaagaccagacgattttcctccgtcgtcacttcgatcataggagtaatctctgccttatccagcttgggtttagctgcagcttttttagcttgaaaatcaaaggatggtttctcttccgctggaggaggtgccatctgttctagttgttccatagcacggagcgcttcctcattggccgcttgaacaatctgctcattttcagcttgaaaggcttcttcctgctcatgagtcagcatatcattcttctctacttgacagttaaaagttggaaatccaaatttttcaagttgtttcgctaaattaggaaggtgattcttcttaaagtgttccttatcaatcgcctcggaaccttcaataaagagttggttcccctccgcacgaacttgcaaattttgataaagggacttaaaaccttgactcgaacacggaccttcagaaaaagcctctctatagtaggactgcaagagctgatttgaaaattcttgagacagagtcttgatttcgaaaatagctttattgcctgtcttaaaaaattcttccctcaaacctttctttaattctaaaaagatttcaatcggtaaaatattagaaaatacgaaatgaaactccaataccttactaattttatgaaccacaactcgctcaatatcggcctgtgctaaagcaggagcctgtctcatttcagcaggcatccccagttgattcatcaaaatttcaaaactatttgacattcattttcctcacattattctcctactattttaccatacttagaggtgttttctaaagacaaaaggaagccactaagtgacttccttctagagtgaggactgattagtcttcacctttgtttttcttaatgatttcttcttgtactgacttaggtacatcttcgtagtggtcaaataccatcatgaatgtaccacgtccttgagatgcagaacgaagaactgttgcgtaaccgaacatttcagcaagtggaacgtaagcacgaacgatttggctgttaccgtgtgcttccataccatctacacgtccacgacgagcagttacgtgacccataacatcaccaaggttttcttctggaacagtgattgttacaagcatcattggctcaaggatagctggttgtgctgatttagcagcttctttaagagcaagtgaagccgcaatcttgaaggcagtttcagatgagtcgacatcgtggtatgaaccatcgtaaagcttagctttaacgtcaaccattgggtaacctgcaagtacaccgttagccatagattctaccaaacctttttcaaccgctgggataaattcacgaggaaccacaccaccgacgattgcgttttcgaattcgaatcctttaccttcttcgtttggagtaaattcaatccatacatcaccgaattgacctttaccaccagactgacgtttgaagaatccacgtgcttgagtagaagcgcggaatgtttcacggtaagatacttgaggagcacctacgtttgcttcaactttgaactcacgacgcatacggtcaacaaggacgtcaaggtgaagctcacccataccagagataactgtttcaccagtttcaacgtttgtttcaacgcggaatgttggatcttcttcagccaatttttgaagggcgatacccatcttgtcttggtcagctttagattttggctcaaccatcaattggataactggttctggaacgttgattgactcaagaatgattttagctttttcatctgtcaatgagtcaccagttgtagtatctttcaaaccaacggcagcagcgatatcacctgagtaaacagtgtcaatttcttgacggctgttggcgtgcatttgaaggatacgtccgatacgctcacgtttacctttagaagtgttcaatacgtatgaacctgattgaagaacacctgagtaaacacggaagaatgtcaaacgacctacgaatgggtctgtcatgatcttgaaggcaagagctgcaaatggctcttcatcagatgctggacgagtttcttcttcatctgtatctgggttgatacctttgatcgctgggatgtcaagtgggcttggaaggtagtcaataaccgcatcaagcatcaattgaacacctttgttcttgaaggcagagccacacaatactgggaagaattcaacgttgatagtcgctttacggataccagctttcaattcttcgttagtgatttcttcaccttcgaggtatttcatcatcaattcttcgtcagtttcagcaactgcttcgatcaatttttcacggtattcttgagcttggtcaaggtattcagctgggatgtcttcttcaaggatatctgtaccaaggtcgttagtatagatttcagctttcatcttgatcaagtcgatgataccacggaagtcatcttcagaaccgattggcaattggattgggtgtgcatttgcttgaagacgatcgtgaagtgtgcttacagagtaaaggaagtcagcaccgattttgtccattttgttggcaaatacgatacgtggaactccatactcagttgcttgacgccaaactgtttcagtttgaggctcaacacctgattgtgagtcaagaacggtaacagcaccatccaatacacgaagagaacgttgtacttcgattgtgaagtccacgtgtcctggtgtgtcgataatgtttacgcggtggttgttccattgagctgttgtcgcagcagatgtgatagtgataccacgttcttgctcttgctccatccagtccatttgtgacgcaccttcgtgagtttcaccgattttgtggattttaccagtgtagtaaagaatacgctcagtagttgttgttttaccagcatcgacgtgagccatgataccgatattacgagttttttcaagtgaaaattcgcgtgccatgaggtttgtttctcctatttatttttgatttctattctattataacatgattttaataaaaacggataggcaggacctacccgttctcaatgttttcatgctattgttggtttcaacttgtagatttacaagttgaattgaactcgggctaaagttaattagccgatttgagccggaacgggatgctgtgtgaaaaagataaacttccttgtattcgtcgaatactgcgtcagttttctattttcaccttgcatccttaccgttcctagcatcatgattttaccaacggaagtgtgcgaatgcacggttagcttcagccatacggtgagtgtcttcacgtttcttaacagctgcaccagtgttgttagcagcgtccaagatttcttttgcaagacggtcttgcattgtgtgttcaccacgaaggcgagcgattgttaccaaccaacgaagtccaagtgttgtacgacgttctggacgaacttcaactgggacttggtagttagaaccaccaacacgacgtgcacgtacttcaagtacaggcatgatgttttccatagctgtttcaaatacttcaagtgcatcgtttccagtagcttctttgatttgctcaaaggcaccgtaaacgattgaagcagctgtaccacgtttaccatcaagcataacgcggttgataagacgagtaactagttgtgaattgtaaagcggatctggcaatacgtcacgttttggagctctatttttacgactcatttctctttatcccctttccttatgcttttggacgtttagtaccgtatttagaacggccttgtttacgatcgttaacacctgcagtatcaagtgcaccacggacgatatggtaacgtacccctggaaggtcttttacacgtccaccacgaagaagaaccacgctgtgctcttgcaagttgtgtccgatacctgggatgtaggcagtaacttcgataaggttgctcaaacgtacacgagcgaatttacgaagggctgagttaggttttttaggtgtcattgttccaacacgagttgcaacaccacgtttttgtggtgaagaaacgtttgtttgaacttttttatgactgttgtaaccaacgttcaaagctggtgatttagatttttctacttttgatttacgcggtttgcgaaccaattggttaattgtaggcatctacattctcctgtgtttttttatttttggtgatgatacacttggtgacagctatcatctgtgtgtacttttgcaacatttgtcagcacgtccctgtacactcttgagagaccaaaagtaaaaagtaccgtgtattattgtaacaaaattttcccttggttgtcaagatatttttcttttttattgttaattttagctcttttgtagtgctccctaaaaaagaaaaaggaggaatcccaccctcctaaagttagtattgttccattcaatcccatcaattttagcacataatggttttcgagatatgatagtatcacaaccaaccagattctttagcgatattggctgcctctgttcgattacctgcatctagtttcgaaagaatattggtgacatagtttcggactgttccgttggatagataaagtttgtctgcaatttcttggttagagaagccctgagcaattccctttaaaactgcgatttcttgttctgttaatggattgggatgcgtcatcaccacttccatcaattcaggcgaatactccttgcgtccttctaggacggtgtgcaaggtttgcatgaggtctgcaatgtttctttcttttaatacataagcatctactccagccttgaccgcacgttcaaaatacccaggacgcttgaaggtcgtcaccacaaccacccttgtttcaagcttttctgctcgtatccattccaagacttcaagacctgtcttaacaggcatttctacgtcaaggatggcgatatccacagacgccttttttaatagttggattgcttcttgcccattctttgcttgaaagacagactctacatccggttgaagcgtgagcaactggcacatggcatctcgcaacatactttgatcttctgcgactaatactttcatctactttctctccttataaggtagtcgaacctgaactactgtcggttgtttctgactaattacctttacttctcccgaaaatggaagaacacgatctcgaactgtatggaggtcatccccctttatagaagtaaagccacagccatcatctctcactgttagaatgagttctttctctgtccgttctaattttaagtagactttagacgctttagcatgcttgatgatattggtcactaactcaagcaaaatcatggaagccgttgactccaattcctgagtaaggctagcggtatctagttgattagccgtttccacctcaattccagcaatctctagcatctttttgacagtttcaagttctgatgctaaggtccgtgatttcagattttccacaatggttcgcacttcattcatggaatccttactgatctggtgaatttcttttaattccttttccacctgtggataagcctccatctgaaacaactgcaaggctaaatctgtcttgacactcagcatagcaaaagtgtgtcccagactatcatgcaaatcctgaccgatacgactgcgttcattttcagcaagcaatagatttatctgggcattttgcttagcctgcgcttctttcaaatcctccacaatccgaatccgaaccaatccaaaagtcattaaatcgacaaaagtaagaattacaagtagatagaatagaaactcaacttcgattctctgaaaaatcaaaagttggcccacaacaaggacttgagcaagaagaaaagtccagacatgtaaagactttaaactacgtacgccaaaatgataacttaagaggttagaaaggaaaaagaagaaccagatataattaacagcaacaaaggcagtattcccaactacataagtcagcatgagaccccaatatatccaagataggcgctggctcttagttgttaaaacacccaaatatgccactacaaatagaatatcaatgaataaatgccagacagaaagccacccagtcactacaggtaggatggggaaaatcataaaaattaaactggcccaaaacatatagtgtatgcttttcagtctttcaagcattaagaattctccttatgaccttgaaggtaaatggtcaaaccaaacaaaactgctgaaaaaacaagtagataaactgtggctgatagattgatgccaccctcgtttaagaaggtcttgagcaactccatcaactgataggttggtaggcacttcccgattgcttgcatccagtctggaaataaagagatgggcatccagagtccacctaacacagccaagcctagatagagaagattgcccactacagacatcagctgactagacggtaagagtgtcagggtcaagccaagtgctacaaaggctatacttcccgcaatcagcaagagcgcagcccaaatccagcttcctaaaggcatatccacacctctaaccaagtgcccaactgagaaaacaaccaggattgagaccaaataatcaaccatcatacttgttatctttgatagataatattctaccatatttaccggagtatggcgcaatgttttctgccagttgttgattttatcggtatgtaagacagctggaaatgaaaacatggctgtcgacatcatggaaaaagccgtcatggagatgaggtaatcacgcataaaattagctggtccaccgggtgtgtcctggtacatgcctgaaaagaataaatagaaggctgtcggcatacctactgataataaataatagactaattgtcgtttggtcaatagaaattctatcttgtttagtgcgatccatcgtttcatcttagtcatctcccttttgtgtttcttcaaagattgtatccaacaaactacgattattgacttcaatttcttgaatcctacatcctgcttgcactaacagttcccagaaagcatttgcctctcgtgtgactacttgcagagcatcttgtttttgtacccacctttcaaccaagtttgactgctcaacgacttccttgtaagctagaggaaggataaaatgcttttcaatctcctcactacgcatagcaagaggcgtcgtgtcacgaatcaattcacccttgtggagcaccaagattcgatcagccgtatgctccacctcttcgatatagtgagaagaatagacaatggtgactccttgcgcttttaggtcccgaacaatttcccaaaaacgttgacgagtagaggtatccatggcagcagttggctcatctaaaaaaacaagctttggtcgcccaattaaggtcaagacaaaagagaaaagacgcttttgcccacctgataatttttctgcaaattgctctttttgttgcttatcaaactgcaatagttgatcgatttcctggttactcaagtgatttggataaattttttgaaagaaaacaatcaactcttttacctttagtttctgaacgattacattctcttgagggaggtaggatcttgtatagtctaacttagagctcgttaccggcaaatcttggatagatacttgcccactggtgaccagtttatctccaagcaaacatgccaaaagtgtcgtcttcccagcaccattgggaccaatcaaggcaacacattcaccatcgttgatttcaaaagagatgttccgcaagatctccttgtcttttattttcttacacaatttctcaactttaatcacagtcatgagattctcccttcaaccactccattcccatagggaaaacgacgaaaatcataaatcctagtccccaggcaccacggatgaattggtgaaggaaggcttgatcaaaccaacctgtaaacatttccaccaaccataccactagtgatagtccaataaaaagatagagaaacgcttttttcatttttcaaactcctttttcacatcactgactaatttcaaaccttctctgataagccaagacatcattccaaagccagcaaagagctcccaaggaaaatggtagaaaccctcatccaaccctgaaaacatgagataggtcataactcctgctactactaaactcactgctataatcattttatttctcatctcttcttcctccatttcatacttcaattatagccttttgaagttagcggagctagatgcttctgtcactaggaaatatgacaaatgtcataaaagattctgttcaaaacaagaaagatacactatacaatgaaacacaagtagaaaaacctaaggcagcttcctcaaaagaaatatcaaacccaatccacactataatgtaaactaatacacattcaaaatcaaaaaagcagaaatttttatcatacaaacacatatattatacgttgaacaaaactcttctattgctttcttaaaaatttataagagttataaaatctgttaaatttcaatgtgtataattaactactgtatttattaaacgatttttattaaaatcattatataaaatgaattactaaaattcttcaacacactacagttgacaaagaaacaaaaaagagagaaccaaactgattccctcttaatgtatataatatcggctctataatatttgtagtgggtaaatcccctataaatattatggagcctatttttgtgtagaaaaaaagtcccatatgacctataatgaaaagtgaccaaacaactcattagaaagattcatatggaacaattacattttatcacaaaactactcgatatcaaagaccctaatatcaaatttatggatatcatcaataggaatactcacaaagaaatcatcgctaaactagattatgaggcaccatcttgccctgattgcggaagtcaaatgaagaaatatgacttccaaaaaccgtcgaaaattccttacctcgaaacgactggtatgcctactagaattctccttagaaagcgtcgttttaagtgctaccagtgctcgaaaatagcggtcgctgagactcctctagtaaagaaaaatcatcaaatccctcgtatcatcaaccaaaaaattgctcataagctgattgaaaagacttctatgaccgatattgcacatcagctttccatttcaacttcaactgtcattcgaaaactcaatgacttccgttttaagcatgatttttctcatcttcctgagattatgtcctgggacgagtatgcctttacaaagggaaaaatgagtttcattgcacaagactttgataatctcaacattatcaccgttcttgaaggtagaacacaagctatcatccgaaatcactttctgcgctacgatagagtcgttcgttgtcaggtgaaaatcattacgatggatatgtttagtccttattatgccttggctaaacagctttttccatgtgctaaaatcgttctagatcgatttcacattgtacaacacttaagccgtgctatgagtcgtgttcgtgtccaaatcatgaatcaatttgagcgaaaatctcatgaatacaaggctatcaaacgctactggaagctcatccagcaggatagtcgtaaactgagtgataaacgtttttatcgccctacttttcgcatgcacttaacgaataaagagattctagacaagcttttgagctattcagaagagttgaaacaccactatcatctctatcaactcttactttttcactttcagaacaaggagccagacaaattcttcggacttattgaggacaatctaaaacaggctcatcctctttttcagactgtctttaaaacctttctcaaggataaagagaaaatcgtcaatgcccttcaactaccctactccaacgccaaattagaagcaacaaataatctcattaaactcatcaaacgcaatgcctttggatttcggaactttgaaaacttcaaaaaacggatttttatcgctctgaatatcaaaaaagaaaggacaaaatttgtcctttctagatcttagcttttcttcaacccactacagttgacaaagagccataatatctagttaaataaaaaagatacgcttgcgtatctctgtactaaatcgggaagacaggattcgaacctgcgacaccttggtcccaaaccaagtactctaccaagctgagctacttcccgagttaaatagaaaaatgcaccctagaggagtcgaacctctaaccgcctgattcgtagtcaggtactctatccagttgagctaagggtgctcattatattatgccgaggaccggaatcgaaccggtacgatcgttaccaatcgcaggattttaagtcctgtgcgtctgccagttccgccaccccggcctctctaagcgaacgacgggattcgaacccgcgacccccaccttggcaaggtggtgttctaccactgaactacgttcgcactgttttcttctatctaaaaatgccggctacatgacttgaacacgcgaccctctgattacaaatcagatgctctaccaactgagctaagccggctcatttattatatcttaatgcgggttaagggacttgaacccccacgccgttaagcgccagatcctaaatctggtgcgtctgccaattccgccaaacccgcatatatgacccgtactgggctcgaaccagtgacccattgattaaaagtcaattgctctaccaactgagctaacgagtctaaaataacttacgttattctaacggtcccgacgggaatcgaacccgcgatcttcgccgtgacagggcgacgtgataaccgctacactacgggacctttgggagttaacgggatcgaaccgctgaccctctgcttgtaaggcagatgctctcccagctgagctaaactccctagagctaagcgacttccatatctcacagggggcaacccccaactacttccggcgttctagggcttaacttctgtgttcggcatgggtacaggtgtatctcctaggctatcgtcacttaactctgagtaatacctactcaaaattgaatatctattcaaaccaagaaaaccttkcgctttcatattctcagttactttggataagtcctcgagctattagtattagtccgctacatgtgtcgccacacttccacttctaacctatctacctgatcatctctcagggctcttactgatataaaatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacaacgtctccttcgaaactggcgtcccgatctcatagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgacttaaagtcagcaccccttctcccgaagttacggggtcattttgccgagttccttaacgagagttctctcgctcacctgaggctactcgcctcgactacctgtgtcggtttgcggtacgggtagagtatgcttaaacgctagaagcttttcttggcagtgtgacgtcactaacttcgctactaaacttcgctccccatcacagctcaatgttayagatataagcatttgactcatatcacacctcactgcttagacagacacttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtacaccttcttcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaatccgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaggtacaaagactattttaaatacgaggctattactctctttggctgatcttcccaaatcattcttctataatctttgagtccacattgcagtcctacaaccccgaagagtaaactctycggtttgccctyctgccgtttcgctcgccgctactaaggcaatcgcttttgctttctcttcctgcagctacttagatgtttcagttcactgcgtcttcctcctcacatccttaacagatgygggtaacaggtagtacctgttgggttcccccattcggaaatccctggatcatcgcttacttacagctacccaaggcatatcgtcgtttgtcacgtccttcttcggctcctagtgccaaggcatccaccgtgcgcccttattaacttaaccttattttttgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaaactctatctctagagcggtcagagggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaaaccccggaaagggtctaacacctagcactcatcgtttacggcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcgtactatggttaagccacagcctttaacttcagacttatctaaccgcctgcgctcgctttacgcccaataaatccggacaacgctcgggacctacgtattaccgcggctgctggcacgtagttagccgtccctttctggtaagataccgtcacagtgtgaactttccactctcacactcgttcttctcttacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagccgttaccccaccaactagctaatacaacgcaggtccatctggtagtgatgcaattgcaccttttaagcaaatgtcatgcaacatctactcttatgcggtattagctatcgtttccaatagttatcccccgctaccaggcaggttacctacgcgttactcacccgttcgcaactcatccggagaagcaagctcctccttcagcgttctacttgcatgtattaggcacgccgccagcgttcgtcctgagccaggatcaaactctcattaaaagtttgagttctcactcatttctgtcactgacagatttattgttttttcattgttcagtactataaccttagttatagtgccctgcacattggttcgtcttgttcagttttcaaaggtctttgtcacttgcttctctcaagtgacaactatattagtatatcacagtcgctttcgcttgtcaacacttttttgaaacttttttaatcttttttcatcaagtgcctcaaccgcaacataccatagtccgtacgggattcgaacccgtgttaccgccgtgaaaaggcggtgtcttaaccccttgaccaacggacctgagctgttattttcaactcttactattatacagactttttctgacttgtcaacaacttttttaaactttttatgtttttttgtatgactccctaatgagtacggatatcaaactccttaaacacaatacgtaagtctctcaatactctttgacgccctcggaagcgttcatgtcttaagacgcgttctaactcttcttgtttgtctttactttgtttgtttctataatctcttagtgtctcatgaaagagataatactcatctagccacatacctccctcactgatacgatgactaatctcacctacttcttcatagggttctttatcatatctacgcttctggctttcttgtttacggatatggtctaaaattcgattacggaatttagttttgaagtatttacgtaaacgaggaatatcttctactagctcttcttctctactgatcaattcatgtaagcaaatcattccctcttggtcccaatctgatagctcccataaatgaaggtaatattcatttctacacttgtatacaattccttggacttcttcatataattctttaaacataacgtccccctttctagatacagtttaacaaataatgaagccaattcggttcttttctccattctgttccctacaccgtctaaactgcataaaaaagagaggtcttgcctctctcagggttataattctgcaatttggtttaggtttacttctgcaactgtgtcattaccaaacatagagataatcatcttcactttattattatcaatctctgtaatcttaccagtatagtctgcaaaagcaccatcaatgatacgtacagtttgaccaacttcaacatcgatatcaaactcttgtacagtttgtcccatagaaaccaagatatcacggatttcttgttccaataatggagttggttttgatctatttccgtgagatccgacgaatcctgtaacgtttggtgtgtttcgaacaacaaaccaagcttcatctgtcatcaccatttccacaagaacataacctggaaagcgattctcttctacttcttttctctttccatttttttcaacttgcactgtttgtgttggaatttcaacacgtaaaatattatccaacatattgtaggtttgtgcacgttgtaatagattttcttttaccttattttcataaccagaataagtttgtaagacaaaccaccctttatcaaaactatccatgatacttcctttcataacagaagatttttagcgtgaataactccacagatcttctaaaaaatgttaataaatcgaatcaaacctgaaacaatcaacttgtcaaaaatataaataatcacaacaaagaaagcagtgtattccatgatagaacgaaaatctctccagctttccttgcgagttggccatgttgtgtctttaagaagtctaaaaatatctccaataaaacgcatcgctctctcctatctcgtttctctgtgtgtagtgtacttaccacaatgtttacaaaatttatttacttctagtcgtgttggcttggggtttccgctgatcttgattgaatagtttctcgaaccacaaactgcacaagctaggcttgctttttttagtgccataacgcctccatcttatctattataacaagaaagctaggctttgacaagcatcttagcgaaatagattgactaccgaatcccatattgtttgagccttttccttaatcttcgcatccgagatagcacgactagcctcatctaccagattttgtgcacgacttctaatatcagaaaggctattatccgcctgattttcttcattacgctgtacttgatttcttgtattggctggtgcaattccattttgcttataagcattttcaaccgtaaaggtacttcctggcgtataaggtaaaatggtattagcaatgtttctaaagacatgagctgcaccgtttgaagtagatcctgctagatagtgattttcatcagtggtagggaaaccaagccagtgactaatcactacatccggagtataaccaattacccactggtcacttgtgtattccggattgaaaacagcttcagttgttccagtttttcctgccatgacatagtctgcaggcgatgaactaatacctgttccgtttgtaaatgttcccaacatcatactggtcatcttgtcagctacagacttatcaatcacccgtttttgtgaatttttatggctcgcaatgacctgaccactagcattttcaattctactaataaaatgagcttccggcattaatccttcatttgcaaaggcagcatatgcttgagccatttgaagagggttggtttcaacaccgcttcccaaggcgacaccaagaacacgatcgactttttccatgttgagtccgaatttttcgcccgcctcaaaagccttatcaacgcccaaatcattaacagtggcaacagcaggcagattaagcgattctgccaaggcttgatacataggaacttctcgactcgttttgatccctgcatagttatcaaccttatagctgtcatactgcatggtatggttatccaactgcttattcaaagcccagccagcttcaactgcaggcgtataaacaactaaaggcttaattgtagaaccagggctacgttttgattgagttgcatagttgaaattccggaatccagttttatcattgccagcaacctgaccgacaactccacgaactccacctgttttcggttcgagagctacacttcctgattgagcaaatgttccatcctctgccctaggaaatagagctgtattttcatagacaacctgcatatttgcttggtagttttggtccagctctgtgtaaatgcggtagccattatttacgatttcttcctctgttagattatacttggaaacagcttcattaacaaccgcatcaaagtaagaaggatagcggtaatctgagatttttccttcatacttatcgtgcaattgcgaagtcatatcaacttctgctgcttcggtttcttggtttttatcaatgtaacccgctgcaagcatattctgcaaaacagtatcgcgacgattggtagaatcttctacagaattcaaaggattatacagttccggcccctttagcattcctgccagagtcgcagcttgatccagactcacttctgatgcagaaactccaaagtatttcttactcgcatcttctacaccccacacaccatttccaaaataagcgttgttaaggtacatggttagaatttgatccttactatatttttttgttaattctaaggcaaggaaaaattctttcgcttttctctcaacagtttgatcctgtgacaaataagcgtttttagctagctgttgggtaatagtagatccaccacctgaacggccagctgttacaatagccaagaagaaacgaccatagttaatcccgtcatttttatagaaagaacggtcttctgtcgcaataacggcattctgcaaatttttactgatatcagtcagttcaacataggttcctttttgaccagacaaggcaccagcctccttttcttcacggtcaaaaataagagttcgagttttcaaggcattttgcaaatcattgacattggttgacttggctacagcaaacaaataggttccaactagcaagcctgcactcaaacctagtataaggacaatctttgttagatgatagcgacgccagaattttcgaattggacccacttgggctaatttttttctatcactgcgagaacgacgcaagctagtagacccagaatcctctgattcacttgtttcttttttaaaaagagaaagaaatttctcgaataatttatctaatttcatgcgtttattttatcatcttcatcataggaagacaagaatttagctatttcctatcaaaatagggctttttttgttacaatatctgtatgcaattcacatttacattaccagactctctacctcaaatgacggtaaagcaattacttgaggaacaactcctcattcctagaaaaatccggcattttttgagaatcaagaaacatattttaattaatcagcgagaagttcgctggaacgagatggtaaatcctggagatatttgccagttaacgtttgacaaggaagattatcccgaaaaagaaatcccttggggcaatcctaacctcgttcaagaggtttatcaagatcaacacttgattattgtcaacaaaccagaggggatgaaaacgcatggtaatcagccaaacgaaatcgcccttcttaaccatgtcagtgcctatgttggccaaacctgctatgtcgttcatcgtctggacatggaaaccagtggtttggttctctttgccaaaaatccttttatcctgcctattctcaatcgcttactggagaaaaaagagatttctagggaatattgggcacaggtcgacggacatatcaacagcaaagaacttgttttcaaagacaaaattggacgtgatcgccatgatcgcagaaagcgaatagttgatacaaaaaatggacaatatgctgaaacacatgtaagcagattaaagcaattcccaaacaaaacttccttggttcgttgcaaactaaagacagggcgaacccatcaaattcgtgtgcacctttcgcatcataacttccctattttaggcgaccctctctataatagtaaatcaaaaacaagtcggcttatgctccacgcctttcgactgtcctttacccatccgcttactctagagaaattaagcttcactaccctatcagatacttttgaaaaagagttaaaaaagaatggatgatagcgtcatccatttttaaatatttaaaaagcaagaccagaggccttgctttttatcgactcatgaattatttagcgatttttgcgaagtattcaagagtacgaacaagttgtgcagtgtatgacatttcgttgtcgtaccatgatacaactttaaccaattgtttaccgtcaacgtcaagaactttagtttgagttgcgtcaaacaatgaaccgtaagacatacctaggatatctgaagatacgattggatcttcagtgtatccgtatgattcgtttgaagctgctttcatagctgcgttcacttcgtcaacagtaacgttcttttcaagaactgctaccaactcagttacagagcctgctggaacaggaacacgttgagcagctccgtccaatttaccgttcaattctgggattacaagaccgatagcttttgcagcaccagttgagttaggaacgatgtttacagcaccagcgcgagcacggcgaaggtcaccaccacggtgtggtccgtcaagaatcatttggtcaccagtgtaagcgtggatagtagtcatcaatccttcaacaacaccaaagttgtcttgaagagctttagccattggagccaagcagtttgtagtacatgaagcacctgagataactgtttcagtaccgtcaagaacgtcgtggttagtgttgaatacaactgttttaacgtcgtttccaccaggagcagtgataacaacttttttagctccaccagcgtgcaagtgtttttcagcagctgctttcttagcaaagaaaccagtagcttcaagaacgatttctacaccgtcgttagcccagtcgatttgttctggatcacgttcagcagaaactttgatgaatttaccgttaacttcaaatccaccttctttaacttcaacagtaccgtcgaaacgaccttgagttgtgtcgtatttcaacaagtgtgcaagcataactggatctgtaaggtcgttgatacgagtaacttcaacaccttctacgttttggatacgacggaaagcaagacgaccgatacgtccgaaaccgttaataccaactttaactaccattagtgatttcctccttatgaaaatcatgaaatttttattgtgaaaagagtaacttgaatcactacaaatcacctttcaacaaacctattatataactatttgagttgaattgcaagtacgggcgttgttttttgtctataccccacttatttttctttctccttcaaaagcctatactgctgtctttctttgtctacctagtcatttcccactttccttttcaaatgaaaagtaaaaaatagaaaagctaaaaattattttcaacactccaattccacaagaaaagagacagggaattcctgcctctaggctgataacaattatttacggcgtcctggtctttctttgtaaccatagtaagaatcttcgatgatttcttgcatatggtcaaccattggaagacgtgggtttgcaggtgaacattggtcttcataagcaaggaaggccaattcacgtgaatgttctttccattctttttcgtcaacaccttgtgctttgaagttcatttggatacctacgcgctcaccgagttcgtaaacagcttttgcaaaagattcaaccccttcttctggtgtagaagctggaagtccaagcatacgagcgatatcttgatatttctcgtctgcacggtagtagttgtacttaggccatgtagctgtcttagctgggcgagtaccgttgtaacggataacgtatggaagcaagattgcatttgtacgaccgtggattgtgtggaattgcgcaccaatcttatgggccattgagtgagaaatacctaggaaggcattggcaaaggccataccagcgattgttgaagcgttatgcattttctcacgtgagtggaagtctgcattcttaactgagctttcaaggttttcgaatacaagtttgatggcttgaagtgcaagaccgtcagtgtagtcgctagccatttgtgatacgtaagcttcagtcgcatgggtcaatacgtccataccagtgtccgcagcaacaaatccaggaactgtcaataccaaagcagggtctacgattgccacggttggtgtcaatgagtagtcagcgattggatatttacggttatttgctttatcagagataacggcaaatggtgttacttcagatcctgtaccagatgttgttgggattgcgatgaatttagtcttcttaccaagcaatgggaatttgaaggcacgtttacggatatccatgaatttttgaacaaggtcacggaagtccacttctggttgttcatagaagagccacattactttagcagcatccattggagatccaccaccaagagcgatgattgtatctggtttgaaggcacgcatgatttcagtaccacgttcaactgtagtgatatctggatctggttctacatcagcaaagatttggtaaacaaccttattgcgacgaagatcaagttgttcgatgatacgatcaaggaaaccaagctctaccatggcatggtcagtaacgatcatgacacgttcaacgtcacgacatttttgaaggtattgaattgaatcacgttcaaagtatgtttttgaaggaagtttcatccattgcatgttatttctccgtcttccgacttttttgatattcaaaaggttaatggcactaacgttatccccaactgagttacgtccgtaagaaccacatccgagtgtcaatgatggcaagaaggcattgtaaacgtccccgataccaccgaaagtagaaggtgagttacagataacacgaatagctttaacagctttaccaaattctttagtcaattcttcgtcagctgtgtggatagctgctgagtgaccaagaccgttaaattcaaccatttgacgagctttggaaataccatcttcacggctttcagatttcaaaactgcgataactggtgacaatttttcacgagtcaatggctcgttttcaccaacttctttacattctgcagcaagaatgtttgttccttctggaactgtaaatcctgcttgctctgcaatccaagttgctggtttaccaacgatgtcagcgttcaatttcgcaccagcacagtttttgctgtttgctttcacgccgaagcagaattcttcaagaagtgctttttcttttttgtttacaaagtaagtatgatatgatttaaactctgctacaaattcatcgtaaatttctttatcaatgataaccgcttgttcagatgcacagaccatcccattatcaaatgatttagacataacgatatcgtgtgcagcttgacgaatgtttgctgacttttcaacataagctggaacgtttccggcacctactccaagagctggtttaccacatgagtatgcagctttaaccatggcattaccacctgttgcaaggattgtcgcaacaccttcgtggttcataagggcactagttgcttccatagatggctcagtgatccactgtacgcagttttcaggagctcctgctttaatcgcagcatcacgaacgatttgagctgcgtgagctgatgattcttgagctgatgggtggaaggcaaagacgattggattacgtgtcttcaatgaaatcaatgccttaaagattgctgttgatgttgggtttgttgttggagtgataccacaaacaacgccaaccggttcagcgatgagagtcaatcctgttacatcgtcttcttcgataacgccaactgtcttagtgtgacgcatgttgtttactacatgttcacaagcaaacaagttcttagttgctttatcttcaaatacaccacgtcctgtttcttcataggcatgtaaagccaattctccgtgggcatccaaagctgctactgacgctttagctacgatgtagtcagcttgctcttggtccaacttacgcatttcttcaagggcaactagagctttttgcaccaacccatcgacatgcttttcagcagcgagtttcttttcttctggtgtcacagtttttttatcagccttattttcctccatagctttcaaggattgatatcctttgttaattttttcacaagtttattataacgcattatttcaactttgtaaacagtttcataaacatttcacaaagaattttttattgtttgtgaattttttatcattttctttacttatcaagtttttccgttagagtttgtgaaatcaatttcaaatattttttatttcacaagcttgattggaagaggagcttggaaagagatagattttctagtaagcgcttacttttagatgctaacaatacctcctttgataaggaggctttatttttgttgaaaaacgccttgtttaaaagtcccttcataaacaacttcttgttctgttgttagtttcccttttccttcagcctgaccatttacaaaatcaccttcgtaggtccagccttctttagattgaaaggtaccttttccgttgaaggctccattgttgaaaccaccagtatactggtctccattttggaaggtaatggtaccttgtccattcattttaccacgtacaagactgccatcgtaaacaatggttccattatcaagctttagaacaccttttccgggaatatttagaaaaaagacgagcacagcacaaaaaacaatcgtaactactgccaaaagctctaaacgttgacgagtcagatagacacgatacttttcgtaaaaattcttaagattttccatcttcactctccttctctaaacgttctaaccatgcttgacaaccctcttgaacacgctgataggtttcctcaaaatctcctgtataccaaggatctggaacactttcagatgcaaatgagtaaatcttatcttgacagtctactggacacatctgacgtaagtcagaaacatttgaagcatccattccgataatataatcaaaggcttcaaaatcttccttactaatctgaagcgatgttttggttttgtcgtaaggaatctcatactgttgaaaaatcccttgagttcccttatgaatcgaattgccatgttcccaagaagaagtcgctcgactttggatttcataattatctgtcattgatttcataacaaactcggccataggactgcggcaaatatttcctagacagacaaagactaattttttcatcccatttcctttcttttatagaaaaacgggagttagtaatcccgtcttatttttcaattgcgccttctagtgaagctgtttctttcagcggtaatacagtcttgatagcagctagttcaaaagtcaagtaaactccatctacatcaagaacaatcgttctcttctcagtatctacttcatcgactgttccgtaaagtccaccgattgtaatcacttcatagcctttttgtagtttatttaagctttccatacgtttttgtgcttgtttcttttgagagcgttgcataaagaacatcaagcccaacatcgctacaagcataattaaaaatgtataatttggattcattgtattctcctttgtcttttacataggactactatatcaaatttcagctacttttacaagattgtacctgcttttctagtaagaaaaaccagagcttacgctctgattcttaggattatttcaagtcttgaacgacttttacaagattttctacagtaaagccatattctgccaatacttttggtgctggggcagaggctccgaaggtatcaatacctagaacggcaccatcaagaccaacatatttgtaccagttttgagttgcacccatttcgactgcaacacgacggcgaacttcatttggaagaatttcttccttgtaagccacatcttgtttatcaaagacatctgtagatggcatgctgactacgcggacttttgcaccttgactagccaattctttggcagctgagacagcaagattaacctctgaacctgtcgcaatcaagatggtatcaaagtctgatgcattttcatagacaacataggcaccttttgcaaccttgtcgaagtctgttccttcttcaacagtcaagttttgacgtgtcaagacaagggcagttggtgttttttcacttgtcactgcaaggtaccaagccgcttgcgtttcacgcgcatctgctggacggaaaacattcagatttggcatggcacgaagacctgctaaatgctcaactggttcgtgcgttggaccgtcttccccaaccgcgattgaatcgtgggtaaagacataagtcacaggaagaccttgcaaagctgacaagcgaacagctgccttcacatagtcagagaagacgaagaaagtaccaccgtatacacgaagtccaccgtgaagggccatcccgttcaagatagttcccattgcaaattcacgaacaccaaactgaatgttacggttcaagcgattggcatcgtcttgaagtccatcagtcttgatataagtcatgtttgagtgagcaaggtcagctgatccacctaagaaggtcggcaacttagccgctacaacgttcaaggcatcctgacttgagttacgagttgcttgtgagaagccattttctaaagctgggaagtctgctggagtcacttcaactggatcacgtccatcgataatagcttctacttctgcagccagttctgggtgagcttctttataatcagcaactagttttgtccaagcttgataagctgatgcaccacggtctgcaacatgttctttgaaatcagcataaacttgttctggaatttcaaatggttcgtagtcccaaccaagagcttgacgagttgctgcagtctcatctgctccaagaggggcaccgtgtacagcattagttccttgtttgtttggagaaccatatccaatgacagtcttcacttcaatcaaagatggtttacctgaagctttagctgcttcgatagcagcatggatagcttccaagtctgttccatcttcaaccaaggctgtatgccaaccgtaagcattgtaacgatcacgaacactttctgtaaaggaatcctttgtctcaccatccaagttgatgtcatttgaatcataaaggacaaccaacttatctagtttttgcaaacctgcgtatgaagccgcctcacttgagacaccttccatcaagtctccgtctccacagataacgtaagtatagtggtcaaagatattgtagccttcgcggttatatttggctgccaagaaacgttctgcctgggcaaaaccagtagcagttgaaattccttgacctaaaggacctgtggtagcatcaatccctgctgtatggccaaattctgggtgaccaggtgtttttgaaccccattgacggaagctcttgatctcatccatgctgacatcttcaaaaccagaaagatgaagaagggcataaaggagcattgaaccatggcctgctgaaagaataaagcggtcacggttaatccagtttggttgagctggattgatacgaagttgttttgtaaagaggctgtatgccatcggagccgctcccataaccacacctgggtgacctgagttggctttattaatggcgtcaatacctaggaaacgaattgcattaacagatagatttgacatagaatttcctttctatttgaggtgattattggatcacacattctattttactattatatgaaaaaatacatagaatagcaattaaacaattcgacgtaaataagtattctatttgctatcctctagtcgcctgatagtagggaagtaagcgtttataagcatcttctaatttttctaaaatcacttctaatgattgattttctatgatagaaacatctgctttaactaacacttttcggatttcttgaccgcctaccttctcgactaagacctgacgattttcttcgctcgcctcccaccgttgactttggccatcagagtaggctaaataataaatcccttctaccgctggaatttctaggaccttggcctgctttcctaaagtttgctcatctttcttgcgctcgatgaaactgacttctagtgagactccaaaatcagaaggacttccatacaaacgaagagccaacataggttctgtcactttcccctcacgctgtatataagcccagaagtgtggtcgcaagcgctgcgcttggttcatccactggctagtctgttggagttgccattctggatggcttgcttgaaaggctttggctaactctgtaaaagcctttctggcctcttgacctttgtggcgaaatgccatcattttctctcgttcttctcccgctttatcaggattacggtactgtaaacctgcaaagtctagatagtctcttatcttattcaacattaatttaatctcctccagctagcaaaaaatcaggataaccctgattttacttattctgtatctacgacaacataacgatttggctcatcaccttcagagtaactggtcacgccatccatacgtgaaataatacgatgaataatcttgcgttcactatttgacataggatctgtttgatgactacggccttcttctaaaacacgagtcgccaatttttgagcataggtctgcaagacttctgcacgatgttcaacataatcattgacattaatagtaatgtagaaggttcttgcatagcggttgtaaagataattttgagccaatagttgtaaggccttcaaaactttaccatggtaaccgataatacgacctggctcattggtatcaatttgtaaattgatgctacgacggttataatcatttgaaatcgtcgcctcaacatccatatcatcaatgattgtttggacataagtcgttacttccgtagctacttgttcaatgtcaaagctcggttccacttttaagcccaaatcttctaattcttgactttcagtttgttcagctcgactctcaacaataggagtttctacttcttccccgaaaccagcttcttcaagctgtaattcatttaaaatctcaatatgcccagtttcttctaaaatggtgttagcatgtttttcatttttcaaaatttcagccttaacttcatcagaaaccccttggccttcttcttcaatctttttaattgcttctacaacatgccctaaatcaacagtcgcttgactgactgttttgactggttcattttgttcgttaatttctttaggaacaccctttacagcctgctgattagctttaatgaccgttgtttcactaatagcttcaatatcaacttgagctggttttttaccaaataaaccaagaaagccatttttttcacgagaaatgactttgatatgagccttcagtcttgggatatctaattctttcaatcctttctggattgcttcttcaacagttgaacctgtaaatactaccattaccagattcctccttattatttcgttttctgagcctttttcttggcttttctttttctattttccaaatctttctgtgcctgaactaccgcctcgcgctctgcgataatcttgaatggattgttcaagaaataggtttgcaagacttgataagcattggacactgtccagtatagggcgactccacctggtgcataaactgcaaagataaagatcaagactggaatcccatacatcatcgcagtcgtagcgccattacgctcagacaaggccttgttggacaaccaagtacttaaaaaggtaaatacagctgctaaaatcggaagaacaagggttgtatccacaccaccaaggttaatccataagaaatgacctgtctttaaaaagtcaactcttgatagagcttggaacaaggccaagataaccggcatctgaatcaaaatcggccaaagagaatctgactgtctgacacccatttctttaaagactttacgcatttcttgctctagcttagttctgctttccatatctcgacctggatattgttctcgaagcgccttaatgcgtggttgagcttcctgcatttttctggatgccaccatttgcacttgaaagactggcaagagcactgtacgaatcaagattgtaaagagaataatccccactccgatactgatatcaaacgataaaaagcgaatgatttccgcaaagaagtaaacaaatttactccaaaaatcagtcgaatctgctgtaatatcactagttgtcccatttgtcgcacaggctgtcatgataaatagagatagacctagcaaactagtcaactgtagtttctttttcactcccatttccttcctggtaaatctttgataattttaatacgtggagtagatttttctccatctctgcgtattccaaggtttcgaccccttttcgagcaatgacaacaaagtcgacatcttctaccagactccctttcgcattctggataatatgtctaattcgtcgcttgatttgatttctagtgacggcattccccagctttttgctaactgatagacctactcgaaaatggtttttctgattttctaattggtagacaacaaatttgcgattggcaaaacttgtcccctccttgaaaatcgccttaaaatctttctctctttttacacgaaagtttttcttcaaaactcaactccatctattaaattactactattataccatatttttcaaaaaagccaatcatagcaaggttttggacaatttcatcagaaaaagaagctggaaaaatcacttttccaactccttgtacggaatattttttctgattttagttattttttcaaacgttcaacgtcacgggcaatgaccaattcttcatctgttggaataaccaagacacgaatcttcgcagcctctgttgagatgtctcctatcacaccaaagacgttcttttcatcatcaacatcacaaccaaaccaagaaattcctgagataacatccttacgtacaacagctgcattttctccgatacctgcagtaaagataatagcatctgccccatttaggactgcaaggtattggccgatatgtttttggatacgatcaacatacatttcataggctaaagtggcatcgtggtccccttcttccatagcagcaatcacatcgcgcatatcactagacttgcctgaaacacccataaggcctgattcacgattaaggacgtgactaatgtcttcaggcgtgttaaagtcctctgtatattgcattaaataaggaatgatggctgggtcaatatcccctgtacgagttcccatcatcacaccaccaagtggagtgaatcccattgaagtatcgacagactgaccacccttaacagctgtaatagatgctccattaccgatgtggcaagtaattaacttcaagtcttctaatggacgtcccaagagttttgcagcttctcctgctacaaactggtgacttgtaccatgagcaccgtatttacgaaccttgttttctgtgtaatattttgttggtagagggtagcgataagctttctctggcatacttgtgtggaatgaagtatcaaacacaactacactggtaatgtctggcaacaattccttgaaggcacgaacacctgctgcattggctggattgtgaagaggagccaacaagctcaactcttcaactttttctaaaacatccccttcaacaactgttgattctttgaaatattctccaccggcaacaacacggtggccaacacctgtaatctcatcgtatgccttgatgatgtcgaaacgaattaagtcatccaataagattttaacagcttgtgtgtgattttcgatatccaaaacttgttgttcggaacggccatcaaattttacagttgaaatcgaatctttcaaaccgatacgttcaatcaagcctttcgccaatactttttcttctggcattaagtataattgccattttaaacttgaacttcctgcattgattgcaattgtttttgtcataacaagactcctcttttaagcgttttcatctattataacaaaatctattttatatttcagtaccttgagtccatttttgaaaattttctttaaatttcattaaaacacttgcatcttgcaggctagcaagtggataaacaaagggttctactggtatttcacttttcttttgtaagataaaaatcgtcttggattgtttagcattagcaaagagattttcagggagactgatcatggcaactagatttgcctcttctttcaaccaccctttcaataagtcactttgaggactggtcaacaaatcactcggagctagaaaaatagcatagccatctgatttgagatacttaagtccttgttccatgagcaagtgatgggcgtaggtatgttcttgactagaggctacttgatggcgcgctgcaacggcatcatcaggataatagccaacaggcaagtcgctgatgaccacatcgctttctttgagcatttgtggacgaacggcatctccttggacaaagccagcctgcaaaccaatcacatctgccatgctagctgccaaatcaatcagcaaatcatctacttccattcccaagtaatccacttttttagcaagcgaagtcaagaaagtagcgcccagaattcccatcccagaacccatttcgaggatagtaatttcctcctctttaaacagctcttccacaataaacaccaaaagtaaagcaatagcatctggcgtaaactggtgattggcctgtaaaggctccgtttgtcctgccttcatcaaaagaaactggtaggtcttgagccactcttccttgcgaagcgctaagcgcttaagggcttgattgttctccttgacctgctctagctcagtttcaccatccaaatagatgctgttttgctccaccaaggcgtcataaaaattggtcgccaaatcactttggatgacttggacattctctagtaaataggtatatgcttgttcaattttttcaaaatccatattcctatcttatcaaatttccctgcgtttttccatccttatagaaaaatcactccctgactaggcgagtgatttttgggctactgttaaaaagagttctgagtaatttccttgaaacaagtcttcagcgctataaagaatctgactatgcacagatgaaaaaccgttctcaattagctgtttttccagttcagtcaattcaaagccgtgatggttggtctccgtcttggtaaaatcagcaataaggagtcgtccatctttcctcaaatgttgatgaaacagcgagagagctgcatccaaatcagtcatatgatgaagaacccgacaaacaacaatgagatcaaactcttgcttcaagggacttttcaataaatcttgctccaaaaactggatattcttgatttcttgctgttccgctttcaaacgagcttgctccagcattttctcagaaatgtctacaagagtgactgacttagcctgcttggctaggggcaaggttaagagccccgtcccaccaccaaaatccagaatttctttgtctgatagaagatcaagctgtttctcaatagcttgataaaccaagtttgctaggaagatatttttaggtgaatcaaaagtttctgctttgtggttaaaatcatgtttcatatttttagtttagcacaaagtagcttgattggctagaaattctctttcttttcaaccttctcttctgattttttcttctctgcttgattacttgaatcagtcactaccttttcctttttatccgttttctcttctttgattttgacggaaggaaagatgaattcatattggctcttaggcgtacgaaccgtcgtcaccaagcttgttttcttgttttgatagcttacctgacctaggttaaaggcctgttccccactttcttgctcaaccttatctttggttcgtttagccatagcaaaagcaaccaatttctctttattcaaagtatagtcttgatagtgggcgacttgtcggttcaagtaaaattgcaacaaaagactaaagatggctgccatggtgactgcatagaggagaactcctgccttaactttttgctttttccacacgatagatgaactccctttctaagcctttttgaaactggaaacgaaaacgaaccacttgattttcctctgtaatctgtgcggatttgagaccataaaccataggctgatagcctcgtccactggcatcggtttttcgaaaatcgtccgatttagacttacctatcgcaatttccttgccatcctgcttcatataaatgcgatcgccttctactttttcgaactgcgaacggtctaattctgcctccagctggtccacaaacaagagccactctttttgctcgctttgttgctggtagcgaacttctgaaatgaggagctgactcatggcctgaaagaggagtaaacttccactgatgacaatgagggcaatcagggattctaacagggtaaaagccttgattttatggctctttgatagccaacaactgttctgaaccatggtagacctccaatcccttttcactagaaaacacctgaatctcaactccgttgatgtttacctgattttgacctgtctgcaaggccatcttagctacacgcaagatctcttctttctgcaagatttttgcttcttcctgcctatttttctgaatttgtcccaaaagaagggtcgcaatgctggcaaagatagctaaagcgactactgcttccagtaaaatcactgccctaatcttttgtttccttaatgcgtttaatttttccatttcctagatataattgataacgaatcgctcctttactggtctgaaattcaaccttagctagggacgaattgcccccagctcggtcaaatgtaatactttggcctgatggtgcctgaattcctttaggaactgtcaacttttgactgccattactgattgtcttcccatctaagtttagactagtcttttgctgactggctacactgcgcttttgggtttcccgataaagttcctcaaactccataaagaaaatctgctcctctaccgccgcaaaagtggactggacagagccagacaagcccaaggcaaggatactcacaagtcccaaaaccaagagactttcaagcatggtaaaggccttaatctgcaacggtttgactggtattttgtttagcatggtattctttataagctttagcctgttcttctgtgattcgcccatctgcttgtaacttgcttagactagcatcttcatttttatccaagctataaagctctgcctgactttccaccaccttaacaacagcagcttttcctttgtcattgaccgcttctttttgcttggtcagattaggtacaaagagcaagagaagcacgctgatgatgagcaagaccaccaacatttccacaagcgtgaaagctttcactttcgcttttttcaagaatgtcatcatttttttcattttaaaaatttacctccatattttgatacatgggcatgagcattgccgcataaagtaaaacgataatcagagccacaaagataaagaccagtggctgcaccagattcatggtgcggttgactcgggtaaaaaaggcttcccaagttttttcagcatagatttccaactcactccccaacttggacttgacttccccatactcgatgatgagactcaactcctttttaaagaaaggataggttcctatggtttgagaaaattcctgaccattttgtagggcatgagccatatcttgaccaatttctttaaatagctgggaaccttgttcctgcatgatttgaaaaatctgcgtcaactccatcccttgagaaatcatattgccccattcacgcgcataataggctgtcagataggtctgcacaaaaattccaagaaaaggaatgcgtgccaggatagaaaagacccgcatcttcgaacctcttttataaaaagtgagtgctaaaaggacacctactgaaacaaagcctaccattcctagaaaaatttgtggcagattgccaataatttgggtggcaatattgctactatccagttgtggtagtaggtagttacgcaaccccagcataattaagagaagaaaccccagcaaaatcaagggataggtcgctacttcaattagttttttcttgaccttggccaaattatccagatattcttctatctttcccaaactcaggtgtagattcccatgaacctctgctagggataactgagtgacaatggcacttgaaaagcccaaactttccatcatttctgagaatgatttcccttgagataagcccgcacgcatctgggttacgcactgcttgtccaacaaggcactcctatctagaaaggagatagtctctaccagatgaaaaccgctggaaaagagattattaaacaaggtgatgatatttttttgcttagctgtagctaattttttccgtttcagcctgaagacttgtgatatgtccatctttaagaagctggtcaatctgcgcattccagctagttgactggtgttcttgatagtctttgtttgcaaagtcaacgattcctcctcccccgattaatctctggtagcagactccttgcagaacgactgccaattcctcctcactcacgcccaactccagtaaacgttcataaactcctcggatactcttggcatgaatggttgaaaagactgtcgcacctgtcaaactggctctgaccactgcacgcgctgtctcgctgtcccgaatttctccgataatcaagagatcaggacgatgacgcaaggaaagtttgattagattttcataggtcaacccgattgcttcgttcaactgcaactggagcatgttgtcctgcttgatttctacaggatcttcgatggacataacttgctgtcctttaaagagagatttagccaattcatgcatcaaggttgtcttgccacttccgactggaccagcaaaaagataaagtccccgttgcctgtactgcttgcccagttcttcaatatcctgaaaccaaaaatgcaaatcctgctcctcatcatgcaacaagcgaataactaaactctcatgccctcgatagtcgcctacagtagataaccgtaaggacgccatcttctggtcatattcatagtcacaggaaccaagctgactacgtcgcttttctccaacattcatacccgccacaaacttaaagtgactgatgacggccgcaaatttttcaaaatcataacaaccgattttacagcgctcgtctcctaccctcatatgaagctcataagcgtctaacttaggaacaaaataaatatcctgcgccccttttttccgagccgaacgaatgatttcttgtgcaatttcttgaaccatacttacctcctcacctatactattcgcaaagatttggaaaaataaaaaaagcaactccaaaaagttactttttctctattttaatttcatacggcaagaacggtgcctttccttacctgtttgtttttcatagcctgggcgtagtttttcatctggaataacctgctcatcctgcaaaagagccaaagaatggtattgttgtaaatactcgtcacattcatcacaccagcgttggtcttctggatcccaaaaaatggtcatcaagtcacttctacttttataaagaggggattcttgttccaatctaaaccagcaagttttgtagtatttgagagcatcataatactggtcaaatttcttacttgctacaatatcttcttcccaaccttctaagaaccaccacggttcaaaatctccgtacatttctataacacgatacatattcattcattcctttgtaccgtatattataaccaattccgctaaacaaggaaagaaatatgctcatttcttaattttttgataaaaaatccagccatcttatgatgactgaatttctatttgcttgtgttccaaaatctttttgctacttaatcttctgaaatatcgttttcgatgatgaccttaattgcatggtggtctgctgctttactgaaaacttcataggctttttcaatttcacttagtttgaaataatgagttaccaatttttctggttcaatcttatgactttcaagagctttcaacaattgtggagtggtatttgtagataccaaaccagttgttacattgatgttgcgaatccaaagtttgtccaaatcgaattcgactggtttaccatgtacaccacagttggcaactgttccgtctataccgataatcttttgacagaaatcaaatgttgcaggaataccaacagcttcgatagcaacatctacaccacgaccatctgtcaaatcataaatttctttaatagctttttcagggtctgaagaattaaccttgtgagtcgcaccaaatgatacagcagtttccaagcggttatcgtctaagtccaccataatcaatttagctggtgaatagaattgggctgtcaaaagagcagccaatccaactggacctgaaccaataattgctacgctgcaaccaggttctactttcccttttaagacaccaatttcatatccagtaggtagaatgtctgatagcataaccaaggcttcatctgacaagtcttctggagtatggtagagagtgttatctgcatgagggacacgtaaatattcagcctgcataccatcaatcaagtgaccgaaaatccagcccccttcgtcttcacagtgggcataaattccttttttacagtagtagcatttaccacaggcacagacacaagaaatcaagaccttgtcgccttttttgaagttcgaaactccttctccaacttcttcaacaatcccaatcccttcgtgaccaagaatggtaccactttgacaagcgggaacatcccctttgataatatggaggtctgttccacaaatagtagtttttacgatacgcacaatagcgtctgttggcttgcgaatcactggtttgtcaacatcaacaaaagaagcaagtcccggtttaacataagtataggctttcataaagcattcctccgtttttttatttgtactgtttataatataattgtaagccttttcatttgcttgttcaagtttttttgtgatttttttaatttttttatttactggtaaagaaatatagataaaaaagcagaagctaatccctaacttctgctttctctcttatgcttgataacgtttcacaccatctagataggttgctaccaattccaaatctttatctagtacgataaagtccgcgtcatagccttcacggatttgaccacagacatcatcaatgtgaacagatttagctgggttgaggctggccatcatgactgcttcatgcggattcgcaatgccccattcgaccacattcttcaaaccgtccttgagtttgaggatagaacctgccaaattacctgtagatttgaggcgagcagttccattgacaactactactgggaattctcccaacatatagtcaccgtcttccaatccacccgctgtcatacagtccgtgataagggcgatattttcagttcctttttgtttgagcaaaatatcacaggccttgggatccacatggtgaccatcacaaatcaattcagcataagtatgtggtaattcatacatggctcccaccataccgagttcacggtgagtcaagccacgcatgccattgtaggcatgtacccaaacgctcgctccagcatcgactgcttttttggcttcatcaaatgtcgcatttgaatgcccaagagcaactgtcacaccttctccagtgatcgtccgtacaaagtcttctacaccttcacgctctggcgcaagagcaattttattaagcaagccattagctgctttttgccaagcacgaaactcatccatacgaggatctttcatataggcagggttttgagctcccttgtatttctctgtgaaataaggcccttcaaagtaaataccacgaatttttgctccacttgcttcccgataacgagcaccgatattttcagttaccgcaagcaattgctcataagaggatgtcaaagtggtaggcaagaagctggtaacacctgtactaagtagtccttcactcatggtatgaagggttccttcgatattattatccataacatccacaccaccaaatccatgaatgtgggtatctacaagtcctggagcaatgctataacctgtatagtcaatcacctcagcgccttcaggaatctgttcgacatgttttccaaacttgccgtccacaagttccaggtaaccgccacgacgaactccgtgtgggtagaaaaattgatccgctttaatatagttaggcataatgttaacctccttaaaagattgattctacaatttattatgtcaattacattataaacctttcttttttatttgtaaatggtatagacctattttctagagatattttaaaagagctggatttctccaactcttctctttttaatacaagttattttgatttaactggcttgtcttgagctgtttgcaaggctgtagcaatggtatctgcatacaatttagctcctgcttcaatcttactattgtcacttccaaaatggacttggtctgttccagtccagatctctggatgctctttcgcaacttggttccaatctgctatcgtgatgtaaggagtcttctctgccaattctctcatataggcagcctctttctcaacgattgcataggtctcttttgtcttatctccctcataaggagtcaccaaaaccatatggtggcccttaggaagattttttacgatactatcccagtcttccttgtaattttcaggattatttaccccagttgcaataaccaccatctttggtagaaatttattctggctattgttgagcatgatttcgttggcggtcttggttgttctgctgacttgtgcattaatctgtgctccaggaagggctgtctgcaaggctgtattagctcttagtgctaccgaatcaccaattaacatagtgccatcagcaattcctaaactatcagcttctgctcgttctgtcatcaccttggtctggctaatatttgttgcagcttgcttcaagccattgacagttaagtctgtctcaaaagctcccacttgtggtgccagcaaagttactaagaagacaatgaaggccaagattccagtacttgctgcaaggattgtgtgaatatgaggcaggggacgaaaggcttgtataataggtgtgttctttcccgcaatccaaggttccagcacataaaatgacaggctggcaaatccataagaaaaaatcaaagtcagtaacacagcaagaagatttgatgtcaactgtgagaaaataatgtagaaaggccaatggaaaagataaaccgcatagctagtatctgctaaaaagctgataatctttggctcctgcatgttaggagtcttttcatgtaagacacgcgccgccagaatcatagcaagggctgcaaggctggcaagcaagaagcccataagataggcaaagagataggtaaatttgacaaagaaggtcaaaatgagtaagaatccaaaacctcccccaaaaaccaaaagggtcttgcgtaaatcccagattttatccaactgcttgacgagggaagtcgtctgacgaacgcctacaatcgttgctaggatacttcccaaaaagaatggatagacatgagttaaactggagaagtaaacagaggaataagaggtcactagaaaactaccaataaacatggagaagaagctgattaaaaaggcagcagctgataagagaaaaaccatccccttcaattgaccatttgatttagcctgtttggataagaaccaaactgccaatccccagaggatatagtagtgaacctcaacggccaagctccaattatgaacaaacaagtgaggaatgaactgtgattcataactcccacctgttagaagttcatagaagttagtcataaagcctaagacacccgcaatctgaccgccaattccagctacatagtcttgacgaaccaagaaagtaaagggcatggtcaccaagaccatcaaaaccacaggtggcacaatccgataaaagcgtcttctaaaaaatccaagcaaatcaatttcatgatttttagaaaattcttcgatgagtagagccgtgatcaagaaacctgaaaatgtgaaaaagacatctaccccgaaaaatcctcctggaaagatggtctgaaagaagtgatacaagagtaccaaaagtaaacctgtaatcctaatcaaggaaaaccatttaatgcgcatacgagtttattcttcctttcattgtacactttattctatcaaaaaaagaagaaaaatcctaagagaaaacttaggatttttagcttatatcaattccagtttaaaaattacgccctgatttattatagccatatttttcaacaaaatactcacggaactccaagagattgtcatccataatggcttgtcgcacttgcttcatcaggttaagcaagaagtaaagattgtgatagctagtcaagcgaataccaaaggtttcatcagccttgagcaggtgacgaaggtaggcgcgtgtatagttcttacatgtgtagcaatcacactcaggatccagtggtgtaaagtcctcagcaaactgggcatttttgacaaccaaacgtccctgactggtcatacaagtcccattacgagcgatacgagtcggcaagacacagtcaaacatatctacaccacgaatcaccccatcaatcaagctatctggcgctcccacacccatcaaatagcgaggtttattttcaggtagcagttgggttgtgaagtccaagacggcattcatctcttcgtgggtttctccaactgctaaaccaccaatagagtagcctgggaaatccatgctgacaaggtcgtgagccgattgacggcgaagatcttcaaatccagccccctgcacaatcccaaataacccttggtcatgcggacgacggtgagccttcaaaccacgctcagcccaacggctggtacgctcgattgatttcttaacgtagtcgtaaggttgataaaactgaggacattcgtcaaaggacatcatgatgtctgagcccaaattattctgaatagaaatggctttttctggggacaagaacatcttagaaccattgagatggtttttaaaggttactccttcttctgtgatattacggctatctgctaaggaataaacctgaaaaccaccactatctgtcaagataggctggtcccaattcatgaacttgtggagaccacctgcgcgtgcgatgagttcatctccaggacgaagccagagatgataggtgtttgacaggataattcccgaacccatctccttcaattcttcaggcgactgagttttgacagtggcttgtgtcccaactggcataaacataggtgttgggaaggtaccgtggggagtgatgatttctcccagacgagctcccgtgtgtttttctttcttaatcaaacgatatttgattggtgaatctgacattttttacctccgaagctgggaaaaacagtcccagttcatactttgtgcccaagggcatactgtatgattttatcaaaaaaagctggaactgtcacgaactatggtgtataatgagagaatgaaatacccaaaaattgatttaaaaaccattcgtctgcaagctagacaatttcaggctgaaaatccccgtctctttctcgtctatctcttacctagcatgctgatcattttgtctggcttcctcaatcccttagagcgcatcaacgagagtgttttagaacaaccctttttaagcgtgtttggccatgtattccaagcctacctttttcctctattagtctcctttatcggaacaatacttctgaccagttcagtctatacaacgctgaaactcatcaagaatccagatacagaactatccgtcaaaaatagtctcactctctttaacgaagagcacttttcacaaacctttttgactctacttctcaaacgtttctatctcttcttatggagcattcctagtttactcgggatttactttctcttttacagtagctttttagccaagaaattcgttgtccttcatcctgagtttcctaatctggatctctcgtcagttgaaactgaacgtttcctcatgacctttggtctctattttctagcaagtatcctcttgatgattgtcggaaatagtctctatattccacaatactatgcctattcgcaggtagaatttctcctctgtgacaccctagacttgggccaagctaaaccagggcaaatccttaaaaccagccgtttcctgatgaaaggctataagtttcagcgttttgtactagacttacaactccttccttggtacttcctcaattggattacctttggaattgctagtttttcactcctaccctacattaaaatcaataaaatgattttttaccgagcagtactggctcgaaaacgtccaaaagcttgaaggtggcccctcaagcttttttctatcaatgagtttctccacctaccaacttgagatcctgatctccatgttctataatagccccgattgccgcttctatccctcgcctaatatccactaaactcatagctggagtagtcggtcgattcaccacctgttccatcatataaggaatgtgcataaaacctgccttaacatgtggaaatttcttttctaccaaatagagagcctgatacatcaaatgattgcagacaaaagtccctgccgtatttgaaacagaggccggcaagccctctttttttatagcttggaccatcgctttaatcggcagactactaaagtaagccggagcaccatctggacgaatgggaaggtcaatcggctgattaccttcgttatcaggaatgcgtgcatcgtcttgatttatagccactcgctcaggtgtcaagctggttcttccacctgcttggccgatacaaaggacaaagtccggttgataacgactcatttcttcttccaatacttgggccgatttgtgaaagactgttggcacttctagccaacggacctcagcaccatggatttcagctggtaaacctttaatggcctccaaagctggattgaccttttcccctccaaagggctcaaaacctgtcactaatactttcatttctaactccttacaaccaattccatgaaactattttcttaaaaacaagtataacatatttcccttattctggagtgaaaaggactagagaggatcagaccggcattaaagtttatttaaagagaaaaatactaatcaaggccaaaatagctggtccaccttgcttcaaaataattttcttatctgctgtgagagagccataagccgcagcaccaatcacaaataaaacaaaaatagtcacaatttctaaattctgtgagaaataaatcccatacaagagaaagactcctacagagcattataaatcccttgatttttaaacaatgaacttactgacggacgagccagttcttccttgtccatgttaaagacacgactagtcgcatctgattgcgttgcaatactttccaaataaaaaatgtaaaaatgctccaaagcaacaatcgttgctaaaatgattgtaataattgacatctatttctccttaaatttctatattttcaatacccaaaaccaatttatttactaaacggctgagttctgttctttcagactctgttaagatactttccatctcttccttaaccttgatatgctgcagaggcggattcacaactaactgctctttggcatacttcgtagcctccaccaaaccttccttttccagaattttgaaatgtcgggtcaaagcagcctaatcaatcttcaaacgctcctgaaccgctatttgattacaaggggaatgcttcagcaaaaataataaaatctgataccgtgtcaaactaatcccaagttttttttaaaacaattgcgtactcgcttgctcagacaagcggagttgataaagcagatcttgaatctctatcatttcttcctcctttttattgattgatcaatagttgactaatcaggtataatgcaaagtaaaataaattgcaagaatgttgcttggattattacaagatggtaacttcccattcaaattgacaaagaaaaaacgaacgagactcgcttcctatcatgaaagctagatctcattcgtaaaaattatatgacagagtctggtttatccattcattgaaacgtgaacgtggtcatagtggttttctgtcacgctaccacggtctggcattgggttccaagtattagctggtccatatttgctatcgaatggagcatagaaacgttgtttccagatgatgtaactaattccacggctagccatgttttgaatagcgtattccgcaatcttatcccctagttctgagctttctggtaccataaagtcgatagccaaaccttttccgtgatctccactgtctcctggacggtaaccactaaaggatgtgatgccaaacaagttagcaatttcttctttaaaggccgctgtttgtggttgaaggcctgcattttcagatttcgctaccgcaagtccagcataatcgggcgctgctggagctgcgtaagttgctgaagttgttttcgtctcttctggttgataagtagaaactgctgctgtagcttcacttgatgatgctacttcttttgcttcttctgaacttgttgcagttgtttcaggtgctgtttcttctactggtattgtagttgcttccactgctgattcagcttgagtgcttgcttgtgtttcatctttctcagctggagtcgttgcctgaggagctgcttctgcaactgcactactcgtttcggctgtttgttcctctgggacagaagttcctgtagatggtgtcacttcttctgaagcagtcactgtctctgtaacttctgaacttgttgctacttcttttgttcttgtagtttctaccgcttttggagcttctgcaatcggttgagaaaggtctgcaacttgaacagtttgatcatctacggttacttgattggttgtcaaatctgctgtcgcagttgtcacttcttcactagaatctgcttgtggagtttggatttcaacttccgttacctcttctgcttcattgacagtcgttgtcaaaacagtttctgggaaaatcaagtccatattcgtgattttattcaaattcgcaagaactgtgacatctacacccaaggcttctgcaattgtgctcaaggtatcaccatactgaacggtataacttgttttgttatccgttttagtcaaatcgttttgaatttgctcaacactctgtgcagtccaaagaacttcttctgcttgagttgccaatactggggcaaatgacaaggctaccgttgaggctaataatattcttttcttcattctttcaaattcctttcaaatgagtacctgtctatgataacacaaaaaatgcagaaaaaaagccctctcgggcctatttaacagaactgtctattccttgtaacaaactcggttacttgaaatagtttgttaggtctctgtcacaaaactgacacaatctttttatcgctcagccttaaaaaaacgggaaatatctgctaacccttgaatcctatgatttccttcataagttgactctaaaaaattaatgctttgaatcttactattctgcgcgaattccacatccagaatccgatcccctatataataggtcttctcagaatccaactgatacttgtctaacagataggtggccgcttctgaactaggtttacgcgcaaagccactctgacttgttaaaatctctgtaaaataagattccaaacccaagtctcttagaatggtaagagcattgtctcccttatgagtgtaaacaaactgctgaattcctgattcctctgcccaagctagcacatcacgcgcacctggcatcaaaactacctgagcattcttctcagccagactctgggcacgcacctgatttagcacctcgacatccagttttcgctcttccgcaactttctccagcaaatcctgcacagaaaacttgagaataaactctctcaccttctccttatcataaggaatagaaaactgagcaaaagtttcctcaatccctgataaaatcgcttcataagagtccaataaagtcccgtctaaatcccaaataaaagctgttttttgcatttcctatcctttcaagctcatatagcgctggtaacggtaacgtagaaataaccaacgaaaaccattatccaaaagggttccggcccaaataccgggcaagccccaaccaagcacaatccccatcagatatcctgttccaatgcggatacaccacattcctatacttgtcgcataaaagggaagccgagcattgcccaaaccctgccagactgctgtatagatgactgttcctatcgtcataggagtaccaagtagtgaaaaaagtgtcactaaaacactagcctccaccgctaaagaatcagtcgtatagagatgagtgagtggtatacccaaagcatagatactgaaggtcaaggggaacatgaggaccagagaaagccaaaaggtttgcttgctcaaattagctactctttcccaattatcctctccaactgctcgggccaccagcatgaccgttgccgtagcgacgccaaaggcaggcatatagttaaactgggtcaagacttctccgactgcattcccagcaactgcctccgttccaaaagacacaaccaaggcaatgatcacgacatcaccagcccgcatcataagccgctctccagctgctggcaaagctaaggtcaatagtttcttatctaaaccaaaagtcggtttctcaaaaggcaactttaattgcgaccataaaatcacaagacctaccaaacgagacagaattgtcccccaagcaacaccagctatccccatatccagaataaaaatagctagacttgaaaaaagaatattcaaggcattggataaaagactcacatagagaggcaaacgtggattatgcgttgcacgaatcaaagcacccagactcgtcatgaaccccaaaagaacaatcgatccgcctaccaaggatagatagagtccgccactctcagctacatctctctccgttcccaagagtccaatcatctcttgcccagcgaagatagacaaagctcctaaaatgaaacttaatagtaaagtaatttttaacgcctcagtcacatgataggctagcttagactgatccttctgccccaaactttttgaaataacactagaaatagctgcccctagagcaatgaaaatcgcctgataaatcgtgataatattaccagctactgaaacacctgaaatagctatcaatcctaaatgagcaaccaaataactgtccaccattcccatgagcatctgcaaaaagttttcacccatagctggcaatgcaatattaagaatgtctttatttttcttaaacaatctctcctcctgatgaaaagaaactcagttggtttcccaaccgagtttactccctctgtcttaaagtcctagataagcctccaccgctgcttgcatatcagtagctgccacggttgtcttgtgacgaactggagatgtttcaaggccatcaactgctggtggtactgcaacacctgaaatttcatgtaattgagccaaggcttcaaagtctgttaaacctactttccctgttacagcctctactgcaaccactgggaacttataaggactagctgttgaagcaatcactgtcttagtcacatcgccagtagccgcttggtatttcttataaactgccgaggcaaccgccgtatgtggatcctcgatataagaatctgactcgtagacacgcttgatttctgctgccgtttcttcttcagtcgcatattcagccgcgaagagttccagaatctctgcatcaaagtctgtcaattcatattgtccttgtgtattcaaggcattcatgagttcagctgtcttaaccgcatcatttcccaaaagatggaaaatcaagcgctctaagtttgaagataccaagatatccatagatggactagttgttactttaaactcacgtttcttgtcgtaaacacgtgtcttgaagaagtctgtcaagacattgttgtcatttgaagcacaaattaatttgccaactggcaaaccaatttgcttagcataaaaggcagctaagatatttccaaagtttcctgttggtactgtgaagttaaccttttcaccagccacaatttcaccagtcttaaccaactgagcgtaggcataaacataataaacaatttgtggtaccaaacgaccaatgttcatagagttagctgatgaaaattgtaacttgttagcagccaatttttcacggagagccacatcattaaacatatgcttcacgttggtttgcgcatcgtcaaagttaccgtcaatggcgataacatgagtattgtcgccagcctgagtagtcatttgcagctcttgtaccttgctgacaccatcttttggataaaagacgataatttcagtacctggaacatctgcgaagcctgccatagcagctttcccagtatcaccagatgtcgctgtcaaaatgacaatcttgttctccaaaccatgcttcttagcagctgttgtcataaagtatggcaagatagacaaggccatatccttaaaggcaatcgttgaaccatgaaacagttccaagttgtattggccgtctaatttcaccaaaggcgctatagctggagtatcaaacttgctatcgtaggcattattgatacagtagtccaactcctcagccgtaaagtcatctaaaaaggctgacaaaactaacttagcaacttcctgataagaagcatctttcaatttgtcaaagtccaaatctacctttggataagtgactggtgtaaacaaaccaccatccgttgccaaaccttgcaaaattgcttggctagcagttactgtattgttggcatcacgtgttgattgataaactaatgtcattactctctatcctttatctatagtctcttccattatatcatgatttttcagaaaattctccttttataagagaaattataggcccaattcttctttcaaaggctgtaaatagcttgtttcttgcttatttctcatctccagtccttcgcaagctagcaggagtatgtgtttggaaaattcaataatcgcagtttcttcctcatttgtaagctttttcttagaaaattgtcgtcttaaaaacttgtaatttcgcccaaattctttaaagaaagtcgctgtttctaagtaagcttctaacttatctaaattaaccaacaatcctaagtgaaaagctgcagaagcgaaggttctctctagaggttgagtacacacactacgaaactcaactgtaccccgagtcgttaagtcttggtactgataactacgatgagtttcaaaatccttctcttgagggtaaataagaatctcatccccattaagagcatatgcttggatttcagttgtagccaaatagtcccttgcctgaatcggataaaaataataggtttgcccatcgcgttccgcagtaaaaattgcagaatgatctagataatcaaaaaaatcatcctcatctttaaagagcctagcattgacaccaacattctctggatatataccatgcatcgattcttcccagaaaatatcccttgaaattttcgtatcccaatcctcacctgaaaactcagaattggcaagtaaataagccttagccccttcaatttgggtaaaagcattaatcactcgtaagtagttagactttgaaacatccaactgaacctgactcccacagataaaagcaccatattcagggaaatgatgcaagtctgattcagccatatttctactcaaattcaaatagtccactaacatctgataacgtggataagcaactggagtattctcatttttattccagttgggatgaataccgcagccaacgatagcatgattggattcgcctaattttctctgaattacatccatataattattaaaacgattttcgacctcttgaattgtttcagccttaccaaatgcaaactcaatcgtagtataggaaacttcaaataaaataacatcctgacttgctggctccactaactgaataggagtcccaaaatcatcaaccttttcgacagtaaaatccaaagcagaaactaaatatcggaataagtacttgataacttcaacatctgtagcatccccttccaagtttacaacaggatattccagctcaatcccgacaaacaattcaggattttctttaatatttttcaaataccgatgttttaataaatcgatagaacgagacatacttccctacactttcataatctaaataaaatttgaataactattattataccaaaaataatataaaaaaggaacgaagatttacaacgttccttaactctatactataccggcggccggggtcgaaccggcacgtccttgcggacactggattttgagtccagcgcgtctgccaattccgccacgccggcaaatagtaactggggtagctggattcgaaccaacgcatgagggagtcaaagtcccttgccttaccgcttggctataccccaataatataaaataggcgagtgatggggatcgaacccacgcatgccagagccacaatctggtgtgttaaccacttcaccacacccgccataattctattaacacgggcagtaggaattgaacccacactgaaggttttggagaccttagttctacctttaaactatgcccgtaaaatggaaggggagggattcgaacccccgaacccgaaggagcggatttacagtccgccgcgtttagcctcttcgctacccttccaaaatatataaatggcgcgagacggaatcgaaccgccgacacatggagcttcaatccattgctctaccaactgagctaccgagccttattgcgggagcaggatttgaacctacgaccttcgggttatgagcccgacgagctaccgagctgctccatcccgcgttaatacaaaaggaggatgtgggattcgaacccacgcacgcttttacacgcctgacggttttcaagaccgttcccttcagccggacttgggtaatcctccaaaatagtccgtacgggattcgaacccgtgttaccgccgtgaaaaggcggtgtcttaaccccttgaccaacggaccaaactttatgggcacgagtggactcgaaccaccgacctcacgcttatcaggcgtgcgctctaaccacctgagctacgcgcccaagttaaaaacttggtaatttgaacaaagttcaaagcgggtgacgagaatcgaactcgcgacaacagcttggaaggctgtagttttaccactaaactacacccgcttaaatgggagttaacgggatcgaaccgctgaccctctgcttgtaaggcagatgctctcccagctgagctaaactccctagagctaagcgacttccatatctcacagggggcaacccccaactacttccggcgttctagggcttaacttctgtgttcggcatgggtacaggtgtatctcctaggctatcgtcacttaactctgagtaatacctactcaaaattgaatatctattcaaaccaagaaaaccgttcgctttcatattctcagttactttggataagtcctcgagctattagtattagtccgctacatgtgtcgccacacttccacttctaacctatctacctgatcatctctcagggctcttactgatataaaatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacaacgtctccttcgaaactggcgtcccgatctcatagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgacttaaagtcagcaccccttctcccgaagttacggggtcattttgccgagttccttaacgagagttctctcgctcacctgaggctactcgcctcgactacctgtgtcggtttgcggtacgggtagagtatgcttaaacgctagaagcttttcttggcagtgtgacgtcactaacttcgctactaaacttcgctccccatcacagctcaatgttatagatataagcatttgactcatatcacacctcactgcttagacagacacttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtacaccttcttcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaatccgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaggtacaaagactattttaaatacgaggctattactctctttggctgatcttcccaaatcattcttctataatctttgagtccacattgcagtcctacaaccccgaagagtaaactcttcggtttgccctcctgccgtttcgctcgccgctactaaggcaatcgcttttgctttctcttcctgcagctacttagatgtttcagttcactgcgtcttcctcctcacatccttaacagatgtgggtaacaggtagtacctgttgggttcccccattcggaaatccctggatcatcgcttacttacagctacccaaggcatatcgtcgtttgtcacgtccttcttcggctcctagtgccaaggcatccaccgtgcgcccttattaacttaaccttattttttgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaaactctatctctagagcggtcagagggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaaaccccggaaagggtctaacacctagcactcatcgtttacggcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcgtactatggttaagccacagcctttaacttcagacttatctaaccgcctgcgctcgctttacgcccaataaatccggacaacgctcgggacctacgtattaccgcggctgctggcacgtagttagccgtccctttctggtaagataccgtcacagtgtgaactttccactctcacactcgttcttctcttacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagccgttaccccaccaactagctaatacaacgcaggtccatctggtagtgatgcaattgcaccttttaagcaaatgtcatgcaacatctactcttatgcggtattagctatcgtttccaatagttatcccccgctaccaggcaggttacctacgcgttactcacccgttcgcaactcatccggagaagcaagctcctccttcagcgttctacttgcatgtattaggcacgccgccagcgttcgtcctgagccaggatcaaactctcattaaaagtttgagttctcactcatttctgtcactgacagatttattgttttttcattgttcagtactataaccttagttatagtgccctgcacattggttcgtcttgttcagttttcaaaggtctttgtcacttgcttctctcaagtgacaactatattagtatatcacagtcgctttcgcttgtcaacacttttttgaaacttttttaactttttttcatcaaatgcctcaaccgcaacataccatagtccgtacgggattcgaacccgtgttaccgccgtgaaaaggcggtgtcttaaccccttgaccaacggaccagagttgttattttcaactcttactattatacaggctttttctgacttgtcaactactttttctgtttttttcaaattaagtaaaaagagccagaattatactgactcttctattgattattaaacttagaagcacgttcttctccccaccaatagggcattagttctgcaactttaaccgtctttcttgtatcgtagtccatcatgacttctgcgtccttattttcagcgttcaactctaagaggaactctctgcaagcgccacaaggcatacccgaacttccaccataaggtggttgctctcgaaaggctaagacttttttaaccttagtttgtcccgaaaattggtacatattgaagagtgctgcccgctctgcgcagagatggaaaacaccacaggttccctccatacagaatcctgtaaatatttgtccatcttctgcttctactgcggcaacgacatgattcgcataaacaaaatcagatacttcatgtggattatacaatttctgtgcttcttcgtacatcttttcccagatatccattgttgcatccttcttatttagagatttcttttagcatgttttcgatatgctggattgatttttcacggcctaacaagaagatagtatctggcaattctggtccatgcatttcacctgaaactgcgatgcgaattggcatgaagagatttttccctttgatacctgtttctttttgaacagctttgatttgtgggaagatattctctgttacaaattcatcatctgtcatcgcttcaagttttgctttgaaggcttcaagaactgttgggactgtttctcccgccatgacttcgcgctctgcttctgtcaattctggaaaatctgagaagaagagatctgtcaatgggataatctcatctactgatttcatttgtggtttatagagctcaactaatttttcagccttgtcagttaaacggcctgcttcctctaagaatggttttgccatttcaaagatagtttctaggtctgcattcttgatataatcattgctcatccagtcgagttttttctggtcaaaggctgctggagacttgctcaggcggttttcatcgaaaagtttaatgagttcttcacgagagaagatttcatcttcgccacctgggttccaaccaagaagagcaataaagttaaagactgcttctggtaaataaccttttttacggtagtcttcgataaactgaagggtgttggtgtcacgtttagacaattttttcccagtttcagagttgataatcaaggtcatatgaccgaactctggagcttcccaaccaagtgcttcatagaccataagctgttttggtgtattagcaatgtggtcatctccacggattacgtgagaaatttgcatatcatggtcatcgatgacaacggcaaagttgtaagttgggtaaccgtctttcttttggataacccagtcaccaccaatattgccaccttcaaattcgatatcacctttaaccatatcatgccacttgtagatacctgactcattgaccgccaaacgaactgttggaatgataccagctgcttcacgttctgcgatgtaagctgctttttcttcttcactcataccaaggtattcgttaatgtagcgaggtgtttcaccagctgcttcttggcgttcgcgttcagttgccaactcttcttctgtaacgtaagatttgtaggcttttccttcaactagcaattgatcgatgaatttttgatacaagtccaaacgctcagactggcggtaattttcatgtgtttctgggctttcatcccaatccatacctaaccaacgaaggttttcaagttgtgaacgttcaccatcttcgacatggcgtttacggtcagtatcttcgatacggataataaaagttccaccatgatgacgtgcgtaaaggtagttgaacaatgctgtacgggcattcccgatgtgtagtagtcctgttggacttggtgcgtaacgtacgcggatatcttttgacatagtttctcctataaagtctctaggcgtctgcctttttgctctctatattatatcacaagtcttggctgaggccaatttctatggataaagagagtaaaaagagtggacaagccactcttttcttctattatagacgtgcgttaagttctttgctcaattcttcaaatcctggttttccaagaagggcaaacatgttacgtttgtaagcttcaacacctggttggtcaaatgggttgatagcattcaagtaacctgaaagagcgatagccaattcgaagaagtagattgtgtaaccaagagtgaaagcatcttgctctggaagagtcacgtacatgtttggtacatcaccatctgtgtgggcaagaagaacaccgtcagttgcttttttgtttacaaagtcaacgtcttttccttgaaggtaaccaagtccatcaaggtcttcttccaagctagggataatcacgtttttacgaggtttgtcaacacggacaactgtttcaaacatgatacgagttccttcttggataaattgaccaagtgagtgcaagtcagttgagaagttggctgaagttgggtagatacctttttggtcttttccttctgattcaccagccaattgtttccaccattctgagaagtattgaagtgatggctcgtagtttaccaagatctcagttgcatagcctttacggtaaaggatgttacgaactgctgcgtattggtaagcttcgttttcagagattttatctgaagtgtagtctttgcgagctgcattcgcaccttccataagggctttgatgtcagctcctgatgctgcgattggaagcaaaccaacggctgtcaatactgagaagcgtccaccgatatcatctggaacaacaaatgtttcccaaccgttagcatctgcttcaaccttaacagcgcctttttggcggtcagttgttgcatagatacgtttgtttgcttcttcttgaccgtatttcttaaccaaaagttctttgaagacacggaaagcgatagctggttcagttgttgtacctgatttagaaatcacgtttaccgagaagtctttgtcagctacgtactctaccaagtcagcaaggtaagtagatgagattgagtttcctgcgtaaaggatttgtggagccttgcgttcttcttttgtttgcaagtttgcaaagtggtggttcaagaagtcgattgctgctttcgcaccaaggtaagatccaccgataccgattacaaccaaaacatcgctgtctgatttgatttgctcagcagctttcaagatgcggtcaaattcttcgcggtcatagttttcaggaaggtccaaccatcccaagaagtcgctaccagcaccagttcctttacggatcaattcatctgctgctgttacttgtgattgcatgtattccacttcatgtggtgcaacaaatttgtctaaaacttttgaataatcaaatttaatatgtgacatgttattcctccaatatttcttcttttctatcataacgcttaccttcgtttttttcaagttttttgtcgaatttctccaatttttatcagaattcaaacgtttgcgtaaaaatcccacattccaaaaattttgaaaaaataaaagaaagaacgactagatgttccagtcgttacagttcattcaataaatactcaaataattctaaattgccatcttcttcattaaccagaaactctggatgccactgcaaaccaataatgcggtgctcatcgatagactcaatcgcttcgatggtctggtctcttgggtcaatagcagttacacggaaattaggtgccaaatctttaatactctgacgatgaacggaattaacttgactttcttttccaaataacttagccaccacacttccttctactgtctcaatagaatgagatgtcccgaaaggtagtccttgccagtggccttcgatttcttgattgagagttcccccaaaggcaacattgacaagttggacaccgcgacagattgccatgattggtttattctgacgaagcgcttctttcaagagcgccaattcaaattcgtcacgcactaggttgtaatcatcactctcgatggtctttttctctccataaaactgaggatggacattttgaccgcctgtcaagataagtttgtcaatcatttctacataatcgcgaacaactgactcatcaccaacaggaatgactaaagggagaccaccgacttgacgaatgctctctgcgaatctacaagatacagatgaatgaatgtttttgccctctgcgtctacgggacatagatttgcagcaactcctacaaccgttctagccatgatgcctctcctttcgaatgttaacgatagtcttatcatatcactcaaaatgactttcgtctaatatgtttttttaaggctgtgataaatattttttatggacaagaaaaagctgcccaaggggacaacttttttcttattcaaaaacaaattgattgtgatagagttctgaatagaagccacccagtttcaagagttcatggtggctaccgcgttcaatgacttctccatctttaaggacaataatctggtctgcattgaggatagtcttcaaacgatgggcaatgacgaaactagttctgcctgctacaaccgcctccatggcatgctgaatcttgctttctgtcacagtatctacgttcgaagtggcttcatcgagaatgagaacctctggatctgtcatcagggttcgagcgatagaaatcaattgcttttgtcctgtcgagaagatgctctggtcatcatctataagagtatcgtacttatcaggcaagctttcgatgtagtcgtgaatatgggttgccttggctgctgcctcaaccatttcttgactagcatctggcacaccaaaacggatattgtctcgaatcgttccgctaaacaagaccgaatcttgcaagacaattcccaccttgcttctgagactatctaaatcatagtcacggatgtctttaccgtcaaaataaatcccaccagcattaacatcataaaagcgattgatgaggttcataatagtcgttttccctgacccagtcggaccaacaaccgctgtcatctggcctttaggagcagaaatgctgacatctttcaaaatgggtttatcaggcaagtatgaaaaatcaatatgactaatttcaacaccttcttgcaactgagtgaaggtcggagcatttttaggtcgaatttcttcctctgcatcaaacatttcctgaatccgttcagcacctgtaaaggctaactgaaggcttccccaacttgccgcaacttgaataataggctggtagtactgctgtgaaaattgggcaaacataacaatcaaacctagggctgtacttgtttcaatagacttatcattcaaaagtacagctgaaccagcaaagatgacgatggctgtgttgaccagactcatcccattcatgacagggaaaagaattcctgagaacattcttcctttaaaggttgccttgcgcacgcgctcattttgttcaagaaatcctgccatcatatcctcttgaataccttgcacaatcacggctttttgacctgagatactttcatccatataggcattgagcttccctacctctttctgctggaggttggtatatttccgtgccattttcacgataaaaatcagcatgagaaaggccactggtgtactggcaatagtgatgagggccagcgtcacatttctcgaaaacatgacaagaatcagaccaatgtatagaacgatgttgctcatgacctgaatcaagctttcgttaaaagcttggaggatattatccaaatcactggtaaaacgagacaggatatcgccatcttgtcggcggtcaaagaaagaaacagtcaaccgagcaagcttgccaaagaggcctttgcgcatctcgttggtcgattctgcaatcacgcgcgtcatgagacacatgtatatcacactggagataaatagaaccaaaactagcagaccaagattgaccatgattcctgataggctttgccaaacaagttctggattgccattttgataagcttgaactaaattagctaactctgttaccgcttgtccagaaaataccggaaagagagcttgggcaagagtcgccagaacaatcatcaggataacaactacaaatgatagcttatagactttaaaataattccaaaaaaattgaactgtcttcattttactcctcctttcctttctgtgtttcgtagatttcacggtaaacggaattgttggcaaccaagtctgcatgcgtaccttgaccaatcaatcgtccttgatctagaaccaagattttatctgcatgaacaaccgagctaatcttttgagcgatgataatggttgtcgttcccttcaagtccttattcaaggcttcctgaaccaggcgctctgacttggcatccaaggctgaggtcgaatcgtcaaaaatcagaatacgtggattgctgacaattccacgggcaatcgacatcctttgtttttgcccacctgaaaagttggttcccctttcttcaactggactttcaaaggttttctccatacgatgaatgaattcactggcttgagcaatattggctgcgcgctccatttcaaataaagtagcatctcccttaccctgtctcaagttatctgcaatcgttccactaaagagaatggcacgttggagaacgatagaaactgttttacgcagggttccttcactcacttctcgaatatccttgcctccaattttgatagcaccctcctgtgggtcaaagagacgtggaatcaattgagccaaggttgattttcctgcaccagtcgctccaacgacaccaaccatttgaccaggttcgatagtaaagctcacatctttcagcatcggttccttgtccattggataggtaaaggttacattttcaaagctaagacttcctaccaagtcttcatctggcacatccttgaaggtcatggctggctctgcgtcaagaatttctcgaatacgacgcatagaaatcatagcacgactgacagaatttcccaaaaatccaaccatgacaatggtaaagataatctggctcaggtaattgacaaaggaagcaatggagccaacaactgacggatccgactgaaccatccccgcaactagccaaatagagaaaaataccgccccataaccgaccaacatcatgaaaggttccactactgaaaaggcataaccgatgtaaagattttgaccgagtagctcgtctgaaacctccgtaaacttagcaaactgctctttttcttggacaaaggacttgaccacacgaacgccacgcaaattttcctttgcaatggcattgatgcgttcaagaagggtttgaaacttggcaaaacgaggccccatcatacccatcatgacagcagtcaaaccaaaaatcaagactaccatgagaacaatcacccaccacagagaaggtaaggtttgaaccgccaagataaacgaaccgatgaacaagagggggagcctgaaaagaatttggaaggtcatcatgacgacgttctgaatctggttgatatcatttgtcattcgaacgactagatttcccgcattaaattgttcaatattagcataagaaaatgtttggattttacggaaggcatcctcccgaaggtcagatgaaactccttgggcaatataggctgcgaggacaacattgagcccaccagcaaccaaaccgagcagggccacaccaatcaaccaagccccgatactataaatagcttcatagttcccagcaaggagggcatctaacacttcctgcagataacgcggctgcagaagtgaactagcaaccatcaagcctgtcatcaggagcgaagccaaggcctgccacttgtaggtttttattttctgaatcagcatactttctccttaaaaaatagacaaaagggagcgacaatgtgtcagctccttctcattctgtttgtgtgatgttattctagcaaaaaagtgagaacttgtcaaagaagtctccttgatacagctagaatgactagtaattttctctttatagtttctgttttaactcgaccaagacattcatagcttgcatgggtgtcatattgtaaacatccaatttagctaattctgctaggataggatgctcttctgccgtatcaaagagtgaaatctgttcagtgacggcacttgtttgtctcatgggagcaggactttctgttccttgactctctagctgagtcaaaatcttatccgcccttgctaaaaggtctgctggcaagccagcaatcttggcaacatggataccgtaggatttatcggctggtcctggttcaatcttgtgaaggaaggtgacctgcccatcctgctccaaggttgccacgtggacattgaccaagtgttgtaaactagactccagactagtcaactcatggtagtgggtcgcaaagagggtcttggctccgatatgctcgtgaatgtattcgattatagactgagcaagagccataccgtcgtaagttgcagttccccgtcccaattcatcaaagagaatgagagagtccttggtcgcatgcgaaatggcattgttggcctccatcatctccaccatgaaggttgactgacctgaaaccaagtcatctgctgctccgatacgggtaaagatcgcatcaaaaataggtaaataggcgctttctgccggtacataggaacccatctgggccattatcgccgtcatggctaactgacgcatataggttgacttcccactcatgtttggccctgtaatcagttgaatactggtatcttctgccatctgaatcgtatttggaatataggtctgagcccccataaccttttcaacgacagcatggcgccctttctggatatcaattcgcgaatcatctccgaattcaggtcgaatcaaatgctgggtttcagccacaaccgccagactctgtaagacatcaactgtagcaattccttgggctagagcttgtaaacgctggatgtacttgctaacctcttcacgaatacgcataaaaatttcgtactctaggttagctgacttctcacgtgcctccaacatatctccctcgatacgggctaattcttcggttccaaagcgttctgagtttttcagcgtcaccttgcggaaaaagtgagcaggcacatttcccagttgcgaattggtcacatggaaatagtagccatcctttttattgtagtcaatcttaagcgtgctgataccagagttttctcgctccttagcctcaatttcagcaatccaactagtcccttctctgagaacgcgacggtacttgtctaaggtctcatcaaagccagtccggataattcctccatctgtaatcacatgaggagcttcaggagcaatcgctgcgctaatcaaactctccaactcagggattccatccagttgttcgatgagataagctagagcaggttgctccattccttctaaaatcgcacgaatccgtggcacactagacaaggtggtcgctagctgcaagagatccttgggattggttttgccaaaagaaacacgactagccaagcgctcaatgtcataaacacccttgagactgtctgtcaaatcactacgctcaaagaaatggtcgagaaagacctgcacaacttcttggcgttggacaattcgttccttatcaatcagggggcgatgaatccaagaccgcaagagacgcattcccatagctgttttggtttcatccaaaagccaaaaaagactaccttgcttcttgcctgaacgggcattctcaaccaaatccagactagccttggtcgcataatccatctgcaaaaaatctttgatttcatagcggataacaggcttgaggtggttcaattccctcatctgagtccgatgaacatactgaagcagtttactagatgccgcttgctccacagctgccaatcgtgaatccagtaaatgaaggtcttcaaagccttctttttcataggaaagtaccagattcatctgacgactaaggatctgttcttcttcctcagacaagtcataacccagcaccacttctcgagccttgagattgcggatttccccacaaaccagcgtaaaatccaaaagacctgtcacataaaaaacacccgtcactaggtccatataagcgaggccaaattgactgccatcacggtctatggcaaccaagaaattgttctgactgtccggcttactactgtcgaccactgttcctggcgtaatgacctgaacaacctctcgtttcacaactccaacagcttgtttaggatcttccatctgctctgcgatagctaccttatagccctgctcaatcaagacatcaatgtactgttgggcagaatgatagggaacacccgccataggaatcggattgtccgcattcttgttgcgactcgttaaggaaatttccagaatctgcgcagcattgaccgcatcctcataaaataattcataaaaatcacccatccgaaagagcaaaaaagcatctggatattgctttttaatatccacatactgttgcatgccgggggatagcttttctgtcgccattttccgtctctccttgtcaaaaataagtcttgagagcaactcccaagaccttacttatctttcatcaaatctagcaaacgatcttccatgagtttggcaacgtgctggtctcgacaaatgaccaataaggtattggcaccagcaactgttcctaaaatccattcatccttgtttgcatctacaatatttgccaaaacagaggcttctcccaatttggtatgaagtaccaaggtaaactctgctcttgcaacaccttctaaatgatgagacaaaaattccactaaatcaatcttttctgtctcatttgctagtacataatacaccatatcatttttcttgaccttggtcaagccgatttcgcgcaaatcacgagacaaggttgtctgcgtcacaaagacattgtgcgcctccaaccgatcttgaatttctttttgtgtacttaatttctcctcagtaatcattttttttattaactgatgacgatctctttttctcataaaatcctcttatatgcatatttataactaattttataactatattataccaaaaaaataggagatttcaaaaattttttcttctttctttaaaattgtgataaaatagtagaaaagtccaaaaaggagctcttaatgaatacaaaagaattgattgctagcgaattggctagcgtcattgatagcctggaccaagaggctattttaaatttactggaaacccctaaaaactcagaaatgggagacatcgctttccctgctttttctcttgcaaaagtcgaacgtaaagcacctcaaatgattgcggctgagctggctgaaaagattaacagccaagcctttgaaaaggttgtcgcaacaggaccttacgttaacttcttccttgataaaaatgccatttctgctcaagtattgcaagctgttatcactgaaaaagaacactatgctgaccaaaatattggtaaacaagaaaatgttgttatcgacatgtctagtcccaatatcgctaaaccattttctattggtcacctacgttcaaccgttatcggagatagcttgtcacatattttccaaaaaatcggttatcaaacggttaaggtcaaccatttgggagactggggtaaacagtttgggatgttgattgttgcctacaaaaaatggggcgacgaagaagctgtaaaagctcatccaatcgatgaacttcttaaactctatgtccgcatcaatgctgaggctgaaaatgaccctagcttggatgaagaagcacgcgaatggttccgtaaacttgaaaatggagacgaggaagctctcgcactttggcaatggttccgtgatgaaagtttagtggaatttaatcgcctttacaatgaactgaaggttgaatttgacagctacaacggagaagccttctacaacgataagatggatgcagttgtagacattctttctgaaaaaggtcttcttgttgaatcagaaggtgcccaagttgtcaatcttgagaaatatggaattgaacatccagccctcatcaagaaatctgatggtgcaactctctacatcacacgtgacttggctgcagccctttaccgtaaaaacgaataccaatttgctaaatctatctacgttgttggtcaagaacaatctgcccactttaaacagctcaaagctgtcttgaaagaaatgggctacgactggagtgacgacattactcacgttccttttggtttggttacaaaagaagggaagaaactctctactcgtaaagggaatgtcatcttgctagagcctactgttgcagaggctgttagccgtgccaaggcccaaatcgaggctaaaaatcctggacttgaaaacaaagaccaggtagcgcatgctgttggggttggagccattaaattctatgacctcaagaccgaccgtacaaatggatacgacttcgacctagaagctatggtatccttcgagggtgaaactggtccttatgtacaatatgcctacgctcgtatccaatcgatcttacgtaaagcagacttcaaaccagaaacagctggcaactatagcttgaatgatgctgaaagctgggaaatcatcaaactcatccaagacttcccacgtattatcaaccgtgcggcggataactttgaaccttctatcattgctaaatttgcaattagcctggctcaagcctttaacaaatactatgcacatacgcgcatcttggatgaaagcccagaacgcgacagccgtctagccctcagctacgcaaccgcagtcgttctaaaagaagcccttcgcttgcttggagtagaagcgccagagaagatgtaaatcgccaaagttacttgattgcaaagcaatctaagtaactaacgccaaatcctgtcaggaatttggctaggcacttcactagtaaagaaacataaatattatcgatttatgtttctttacgtcgtaaccagagacacttgcctaaacgcctcactaaattggtcaaccaaatctattaattggcttagtggctggtggcaatcttcaagtcactagaatgcaaggcaatctaagcaacgaatgtcaaaccctatcagggatttggttaggcgcttcactaattcaatctactcactactacttctttatcatacagggagatattctatgagccaatatgcttatatcctcgttgtaattagcttggtgttcctttttctgctcaataagtacgagaaggagagactgcaaaaactctaccaagaacaacttttgaaggatgaaacatttaggactgatatcaaagagaaaattcacacgactgaaaatatcaatgatgtcattgcttacatcaataaaacttatcatctgggaatgttgctatcaaaagacattacagatcaattgaaataaaccgagttattctttaaggaatataaaaaccgagtctaagagtttaatacttaggctcggtttttatatatttttcaagtaacaaagcaaccactcccccagcaatgcaagtgcaaaatcctccagaatatgatagaataagagaaaggactctatcaaggaggaaaacatggaaaaacaaaccgtcgccgtcttggggcctggttcttggggaactgccctttcacaagtcttaaatgacaatggacacgaggtacgtatttggggaaacattcccgagcaaatcaatgaaattaatacacaccatactaataaacactactttaaagatgtcgttctagatgaaaatatcattgcctacaccgacttatcagaggcactgagagatgtagatgcgattttgtttgttgtcccaacaaaagtgacacgacttgttgcacaacaagttgcacaaaccctagaccataaggctatcatcatgcacgcttcaaagggattagaacccgatagccataaacgattatcaaccatccttgaagaagaaattcctgaacatctccgcagtgatattgtcgttgtttcaggacctagtcatgcggaagaaaccattgtacgtgacctgactttaatcactgctgcttctaagaatttacaaacagctcaatacgttcaagaactctttagtaatcactacttccgactttataccaatacggatgttatcggggtcgaaaccgctggtgctcttaaaaacattatcgctgtcggtgctggagccttacatggtttaggatttggtgacaacgctaaggcagccatcatcgctcgaggcttggcagaaattacccgcctaggggtagcactcggtgccaatccattgacctatagcggcttatctggtgtgggagatttgatcgtaacgggaacctccatccactctcgtaactggagagctggagatgctcttggtcgtggagaatctctagctgatattgaagccaatatgggcatggtgattgaaggaatttcaacaactcgagcagcctatgaactagcgcaagaacttggagtctatatgccaattacacaagccatttaccaagttatttaccacggaaccaatattaaagatgccatttatgacatcatgaacaatgaatttaaagcagaaaatgagtggtcttaaccctctaaagaaaggattcttatgacatcaaaagttagaaaggcagtcatccctgccgctggactcgggactcgatttttaccagcaaccaaagcacttgctaaagaaatgttgccaattgtagataaaccaactatccaatttatcgtagaagaagctcttaaatcaggtattgaagatattctggttgtcactggtaaatcaaaacgttctattgaagaccactttgactcaaactttgagcttgagtacaacctcaaagaaaaaggcaaacatgacttactaaaattggtagacgaaacaactggcattcgccttcactttatccgtcaaagccatcctcgtggtcttggcgatgctgtcttacaagcaaaagcttttgtagggaatgagcccttcgttgtcatgctgggtgacgacctaatggatatcacagatgaccacgctgtccctttgacaaaacaattgatgaacgattacgagacgactcacgcatcaacaattgctgttatgcctgtccctcatgaagaagtttcagcatatggagttatcgctcctcagggtgaagggattaatggtctctacagtgtcgaaacttttgttgaaaaaccagctccagaggaggctccaagtgatctagctattatcggtcgttatctgctcacaccagaaatttttgagatcctcgaaaatcaagctcctggcgctggaaatgaaatccagcttaccgatgctattgatacacttaataaaacacaacgtgttttcgcccgtgaatttacaggagctcgttacgacgttggggataagtttggttttatgaaaacatctattgactacgccctcaagcacccacaagtcaaagatgacttgaaagattacctcatccaactgggaaaagaattggctgagaaggaataacaaaaaaagataaggttcaaaaatgccttatcttttttattacataactattcttataaaccttcacaaccccattcccttgtagagaagtaagactgcaagtcctacaaacaagactaccgctcctaacctctggctggtactatacatccgtctttctcctcgaactggaaagataattgctagaaatgctccaccaactgctcccccgatatggcctgctaggctgattcctggaatcagaacacttccaataatattaaccacaaaaagtgtcagataggattgccccaactgctggatataaggattacgcgtagcatagcgaagaatgataatcgcggcaaatagcccatagagagaagtagaagctcctgctgctaaggattttggactaaatacaaaaacaaagagattgcccatcattccagataagagatagagaaagaaaaacttcttggatccgaaaatttcctctacttgtctaccaagataataaagggaaaacatattaacaatgaaatgctcccaaccaatatgaacaaaaatggcagaaaagagacgccaaatctgctcgggaaagagccgaatagcaggcccatacatggctccaaatcgaaataaggtatccgccctgtcaaagtttccacctgtagtcaccaacattagtagaaacaccaaggccgtcactaagaggaagaaactcgtcacagggtaacgcctatcaaagatttctttcatcaatcagtacctcctgaacaggaatatcatgcttttcagggataaagtcctgaatttgacaaggataaaccgtactcaaagtatgaccagaagaatgttccagatagcggtcataatagcctccaccgtatccaatccgatatccttccgtcgtaaaaaccagaccaggaacatgaatcaaatcaatctgagaggcatccaccacttccaaatctccctgtggttccagtaatccaaaggaagttttgaccagttgttgcggacgatatactacaaactccatgcgccccttgggataggttttgggtatcagaaccttcttgccatccttctgcgcctgctcaatcagttcctgcgtttgaaattcgtgcggaaaagagagataggttgcgatgatcttagcttcttggtaaaaggggtgttgtaaaagtcgctcagttaaagcttggtctataaactgtttttgctctcgagggttagccttcatttcttgcaagacttgcttccgtaattccgatttcatagacaacccctctactctgctgccttctttttcaggaaactagagaccgcatccactccaatagctaatgcttcttccttaggactcatctgagggtgatgaagggcatagggactatcaatacctagccagaacataacgccatcaacttttgaaaggagataaccaaagtcttcacctgtcatagcaggttcgatatcaatcaactcaattccttctttttcctcaaagaaatccatcagttcacgcgccaaggctggatggttctcaacaggcaggtaaccaccttgtttgagttccacttcgacttccatattgaaggcagctgcaaccccttctgcaactgttttgacccgcttttgcaccaagagactcatatcctgtgtcaaagcccgaatagttccatgtaaaaaggctgtgtctgtgatgacattgtttgttgttccggcttggaaaagaccaaaggtcaccactgctccctcgattgggttgacattgcggctgacaactgactgcacttgggtcacaaagtaactagccgccaccaaggcgtcattagcttcatgtggaaaggctgcatgtcctcctttgcctttgaaacgaatcttcacctcgcaagtcccagcaaagagtgtatgagtattggtcgcaatctgtccaaccttcaaatctggccgaacatgaagtccataaaactggtctggcaaccagtctccaaaagcgtcatcctcatacatgagcatgccaccagcttcattttcttcagcaggttgaaacagaaagagcagattgttctttggttgctcctcaagggcgcgctcaagacagcccaaggcaatggtcatgtggaaatcatgtccacaagcatgcatacgaccttggtgctgagaagcgaaagaaaggcctgtttgttcgacgataggcaggccatcaatatctgttcgccaaccaatggtacgctctggctgacttccctgcaaataaaccaaaatccctgtccgccaagtacgaacttgaacaaaattcttgcccgcagtcaatttctcaatcacatctagcaaataagcatgagtcttgaactcctccaagccaatctctggaatctggtgcaaatctcgtctagtctgaatcaaatctaacatctatctatcctcctatatagcagaaagaggctggaaaaagggttccgcctctatttttcttttacaattacaaggtacgaagcgcatcctctagcgctgttttttgttgggtttgagcatcaatttctttgataatacgagctggaacacctgctactaccacgttttctgggacatcttgggtaacaatagctcctgctgcgacaactgaaccactaccgatttgaactccttcgatgaccactgcattagcgccgataagaacattgtctccaacacggactggttcagcgctagctggctcaatcacacctgccaaaactgcacctgcaccaacgtggctgtttttcccaacgatagcacggccaccaaggatagcacccatatcaatcatggtccctgcaccgatttcagcaccgatattgatgactgctcccatcatgataacagcattgtcaccaatttcaacctggtcacggataatggcacccggctcaatacgagcattgatagtacgtttgtctagcaaaggaactgcggaattacgagcatcttgctcaacaacatagtcttgattttctaccaaaccatcgagaagcggagccacatctttccagtctccgaatagaacatttcctagtttaacaacagagctaggtacagcagttgcgagttgtccctcaaaggttactttcacactggttttcttttcagcattggcgataaattgaataatttcttgtgcgttcatttttgtagcagtcataggcgcctcctagttcattttaatgatacctattctaccaaaaaaggcctcaaatttgaagcctttttgtttgtttttaggtatgatttttagggatgtgagataaaacgtgctgtcggtaaaagcaagcccctaccgatacaacctaaaaacactcttcacaactatctccccgtgttttattgactattctagtatagcacacttttagaattaagaaaagactttttatttactttctttcgcttcttctatcgataggaaaatcatgggcaaaataatcaaggccatagctagaagaagggaccaatccactaccaagcctaaaaataaaacactcaaaagggcagaagagagaggttcactggcactgataacggaaaccaccaaaggagaaaccaaggaaacagccttcatggaaataaaaaaagcaaaagccgtcccaaaaaaagcgataatgagacaaattaagatactccaaatatcaggagtaaaggaaagctgataaaccggcgagaggacattgctaaataaaccagccaaaatcatcccccacccaacggtgggtacaaaaccataacgcttagcaaaaggttgaggtaagataacattaaacatgacccccatggcactcagcaaacccgtcacaagtgctagtggtgtcatggataattgagagagatctccctttgtcgccatcaggcaaacacccaacatggcaaccaaaacataaagaatagcactttttgacgctcgtttttgataaaccaagcgattgtaaaagaggataaagacagggctaataaactgtaaaatagttgctgtcgctgcattagaatattctacgcagaggtagaaaaaatactgaactgaaaaaatccccaaaatagcataggctaaaaagggtaggtaatttttcttatctcgccaaatatctaacacttgcgattttaattgcactgcagaccaaatgagcacaagactccctgccagtgtcaaacgcatagaggtaatccagcccgaagacacctggtaatgagtaaagaaatactctcctaaaatcccacagattccccatattaagccagatagaagcgaataaatagttcctttaacaatctttttctgatactgattcatacctttattgtaacatgaaaggaaaaaagaaaaaagtggcaatcaataccactttcctatcttctactatttgattgtgttgaagatgaacttgatgcactgctagaactactacttgagctactacttgaacttggtgtagatgagaaactaccaataatacttgaccaagcattttggtaatctgcttcacttcctccaatagcaaagtgatagcttgtcgtaggagctcccgccttattagcccaataactcgttacagtagcccctgaaagatccaccgtttttccattaacggatactttgcccggcttttgccctgtagatttgaggacctgagattgggtcacactagaatcaagattaaagcgttcattgccccaaacaccaggctcagcctgttggatagcattgaccaagtaagccatatatttggcatttcgataatgcccagcccccttagccatcgggcggttgtcatcatgccctagccaaccacctagagtcaatcttggtgttgacagcatgagccacatattttcatcttcattagttgtaccagtcttaccaatccagtctgcacgagctaagcttgaattgatagaagccaaatccgtttggaaacttgaagtgatccgagatgaaatcacctcacgaagcaaactctgcataattgttgccgttgccttcgagtacacttgaactggtttgtcttggaattcatagattactctaccgtcaggtgattcaatcttagcaatcacatgtttctgatgataaacaccgttattagcaattgtttgataaccattggtatgctgggcaactgtgacttcaataccaccgcccataggcagactttcgataccgtactccggaatctcgtaacccattttctccatgtaacccttgacatcaacacccttctcacgaagcatgcgataggtccaataggctgggatattccacgaatagttcaaggcttcacctagggtcatcatgcctgtacctggactatttacatacatgataggatttccattagagaattttgtcggataattggacaagatactagcgcttcccatcaaaccttggtcaatggcaataccgtaggccaacaaaggcttggttgtagaggctggcgaacgcttggtgtcgaaggcgtgattgttttggttagtctggtaattacgaccaccaacaaagcctagaacagcccccgttttattgtccatcaaaacattccctacttcaggctgcccagtcgaatcatctaccaaacgaccgtagttagcaactgcattttgcatggcgttatggatttttttattgatcgttgtcgtgattttatagccgccattacttagttcctgctcagctcgctcatgataagccttttgaatcgactcgtttttcaactcttggctagagacattgtcctgttgaactaagtaatcatacatgcgatctgtagcttcagccatagctgtaaagtagagataatccctcgaaacaacattgatagatcctgatggcaagaaatcttgcttgagattataatccttgtactggtcgtattcttcctgagtcagagcacccgtacggtacatgttgtagagaacatccttggcccgcttcaaaccaagttctaagtcttcatcactctttaactctccagtattttcataaggggaataagtaatcggactctgtggcaaacctgctaggaaggcagcttggggaatactcagcttgttggcatcgataccgaaaatcccttcagcagcttgctgggcacctgcaatattctgccctttatgatttcgaccaaagggagcaacattgagataagtagtcaagatttcatccttactcatgctgcgttccaaggcaagggcatcaacaatttctgtagccttacgagccaaagtcggagcatctccaaccacttgttgtttgattaactgttgggtcaaggtcgagcccccgctagatgagcccaaacctgcaaaggttcccaaagtcgcccgaatcacagcttttggcacaaccccattatgttcaagaaaatgttcgtcctcagttgcaacgatagcctttttgagattgtccgatatttcctcagatgagacagaagttctcagtaaatcactctcgatagaagcaatgacactcccatctgcataaacaatttctgagatagaagaaatatttttaacctgcttgaccaagtcctccgattggggaaccttagccttgtcaaacaaagcaactccataaccaagagctacaccagcaccaaaaagtccaccgataaagcctagaataaagagagtattcaaaattcccttgatagcagctaaaatgctacctaagatagccagaactttcccacctgtcccatccgacttcttctcttctgagactttctctgattttttatgatttatttttgattttactagctggaaaaattccagcatttttcgttttaattcatttaattgattttgcatggatttcctcactttatctattataccataaaaggtaaactttcaataaaatagccactttcttccttattctactaggctattgcccaagtttgtgatacaatagttagaaacaatatttttaaaaaggagaaaagacacatgcacatttttgatgagctaaaagagcgtggtttgatttttcaaacgactgatgaagaagctttgcgtaaagccctagaagaaggtcaagtttcttattatactggctacgatccaactgctgacagccttcacctaggccaccttgtcgcaatcttgacaagtcgtcgcttgcagctagcaggtcacaaaccctatgcgctcgttggcggtgctacaggtctcatcggagatccgtccttcaaagatgctgaacgtagtctccaaacaaaagacacagtagatggctgggtcaagtctatccaaggacaactttctcgttttcttgactttgaaaatggggaaaacaaggctgtcatggtcaacaactacgactggtttggcagcatcagcttcattgatttcctccgtgatatcggaaaatactttactgtcaactacatgatgagcaaggagtctgtgaaaaaacggattgaaacaggaatttcttacactgagttcgcttaccaaatcatgcaaggttacgacttcttcgtccttaaccaagaccacaacgtaacgcttcaaatcggtggttctgaccagtggggaaatatgacagctggtactgaattgcttcgtcgtaaagctgataagactggtcacgttatcactgtaccactgattaccgatgcaactggtaagaaatttggtaaatcagaaggaaacgcagtctggctcaatcctgaaaagacttctccatacgaaatgtaccaattctggatgaacgttatggacgctgacgctgttcgcttcttgaagatctttactttcttgtcactcgatgagattgaagacatccgtaaacaatttgaagcagctccacacgaacgtttggcacaaaaagtcttggctcgtgaagtcgttactcttgttcacggagaagaagcttacaaagaagctcttaacatcactgagcaactctttgcaggaaacatcaaaaatctttctgttaaagagctcaaacaaggacttcgtggagtgccaaactaccaagttcaagcagatgaaaatcacaatattgtggaactgctcgtctcatctggtgtggttaactcaaaacgccaagcccgtgaagacgtccaaaacggagctatctacgtcaacggcgaccgcatccaagaccttgactatgtcttgagtgacgcagataagttagagaacgaactgactgttatccgtcgtgggaagaaaaaatactttgttttgacttactaaactattcaacatttatctataaacaaaggagttatcctcgagaaaggtaactcctttttgctgttaataaatctcatctatctatttttaatagacagactacgcagtacaatgcgcaaggttgttagattatgtaagatagagagatttgaaggactgagccaattaaacaagccaaagccaatcaaactactatttacgacaacggtatcttgaatattcttcttgatgagtgtttgcaaagatgatgatagcgaatccaactcttggaagaaatccaagcgattatctaacaataagatatcactcatctgcttagaaatatctgcactctcattcatcaccacaccgatatctgatagggttagagccgctgagtcattcaagccatctccaaccatcaaaatagtgtgacctgctttctgcagttcctctactaactcaaatttcccatcaggtttcaagtctgtatggacctgatcaaagggcaaatctttgactaattcctctgttctaaccagggtgtcccctgttgccagaatcaattttttcccttgtgccttaagtttctccaaggctgcttttgcttcttttctcaaaggagtatgaatgcagaacattccaatcaattcattctgataagccaagaataagagattatagtgactcttgtactcttcaattaaagcattttgttctgaactgatatgaatttgctcatcctgcatcaaaacataattcccaataagaactggttgcccatctatatgagatttgatccccttgcttgcgatatattggagtttcccatgcatttcctcatgttcaattccctctatctcagcttgcttgacgatagcattagcaataggatgataaatgtgttcctcaagacaggcactgattctgagaatatcttcctcactatagtccccaaaaggtaacaccttttcaactataggatagctagttgtgattgttcccgtcttatcaaacaagaaagtatcaacttccagatatttctccagaacatccccatccttaatcaccatttcacggttcaacccctccttgatagctgtcaaataagctacaggagtagagattttcaaagcgcaggagaaatcgaccaataggaaagaaatagccttagaaaaagaacctgttaataggtaagtcagaccagcccccaagaaattatatttgacgaccttatccgccatcttgatgaaatagcgttgtttcgttttcttgttttcttcagatttcttcatcaactcaatcagctgtaaaatccggctgttcatctgattatcggttacacgaatgcgtaactctccagtttccaatactgtatttgcacaaaccaaatcagactctcttttttcaactggaaaactctctcctgtcaaggaactttcgttgaccatacctaaacctgaaactacttgtccatcaaacagaatttcatttccttgagataggaccaagacatctcctatttgaacatcggaactcttgatactaacaaccgtatccccctgtactagaaatacatcgctctcttttgcaagaaggctttgttctaaatctgttgcagtttttttcaaggaccactgatctaaatgattccccaaatcaagcataaacatgatattgctagctgtcttggattggttcataaacaaggacaataaaatcgccgaacagtccaagacctccatcgttagttccttacgcgctagtgtttgataggcttctctaatatagccaaaagcctgataacaagtccatatatagcgaataggagacggtacaaaactacgaaaaagtatacgcttaatcgctgcacctgaaacaatagaataagcactctcttctctacgaatgggaagagtcatcaactcagaaactttccctttatcaattctttttaaaaaggcttctgcattatctaatacagaaaagccttcttttatgcgtagagtaaagtgctgttgatccatgtaaaactggatagactcaatccccttttcatctctcgccaaggaacgaagatagtcttgaatatccaaggtgagtgaaaaagaagatgatagtcggatatgttggtatcctctatgtagcactttaaaagacatattattcccctataaggctatctaattgctcttcttttttctcttgctcgtacaaatatttggcatcttgcaagacatcgtctccatgttgcttcacaacagaaacagatgcatctagctcgtcttttaacttataagccttagccaaagctttagaataaccttttttagcttccttacttgccaagattttcaaaccaagggtaccaaatgcgacaccacccaaaaagagtgatgattttttcgcaacttttgcgacggttaatacttcttttaacatacttatttcctccttatcattattatatagcaatttagatataaaagcaatgtcatttcataaattggagaa

SEQ ID NO: 71 - DNA, 22040 bp, Streptococcus mitis NCTC 12261 contig17
gaaataacagtgaaagctgttataggtttcttttgtgtagattgcatagctgtctcctttctttaatattctacgtcatttccgagcgccttaaattgaacaaagcttacaatagcaatcatgactgccaagaagacaccaatggtattagcatacccgtattcggtcaattggaaggctttttcgtaaaggtagtacatcaaggtacttgttgagtagtttggcccaccagatgttaatagttgaatcaaggcgaaaacttgaaatgagttaattgttgtgatgattgcgatgtagagagttgttggaagaaggcttggccatttaatcttccagaaaacttgaaattcagttgcaccgtctacacgagccgcttcaaccagtgaattgtcaatattccccatagcagctatgtagaggatgattggttgaccaactgaagttgtcaagaggataatcataattgccagtaatgcccagtgtttatctcccaaccaagaaatattctggctgatgatatggcttgacttaaggacaaagtttagaatccctgataatgggtcataaatccatttccaaacaactgttacggcaacactacctgttacaacaggaaggaagaagacgaaacggtagaaagatctggcaatagcattttgatggtaggtttgcgacgccacaaagagcgaaaagagaacaacaatcggtacagatccaacaaccaaaataactgtgttaatcaaagacttcataaagacagggtctttaaacatacgaatgtagttgtccaatcccacaaactcaaatttagtcattgaatagttaaagaaacttgtaatgaatcccataatcataggaaccaatacaaagatgacaaagaagaataatactggtgctaagaaagcgtaggaaatcactgtttcccgcatacgaattttattgactttcacagtcggcacctctctttcacaaatagaatattttggattttcttgaacagttttaaaatcaaaatgaaattttttaagattcgcttatgtaagaacttcattttaatttcgtgacagtttctgatatttcaaataaaatcctcccttttcttacatagattatgcacagggaaaagggaggagtcaatctgattcagtgcttattgttttgtagcttttttaattgtttcgttagctttttcagtgaaggcttttaaagcatccgctggtttttgatcgccatttgaaactgattgcaacattgggaaccatagagttctcatttctgcaaaaccatcaattgtattgtagtatggtgagtagtatttagtccaaccactgattgtttccatacgtttatcttcataaagttttccaaatgaagtacgaactgggaaggaactttcgttgaccatacctaaacctgaaactacttgtccatcaaacagaatttcatttccttgagataggaccaagacatctcctatttgaacatcggaactcttgatactaacaaccgtatccccctgtactagaaatacatcgctctcttttgcaagaaggctttgttctaaatctgttgcagtttttttcaaggaccactgatctaaatgattccccaaatcaagcataaacatgatattgctagctgtcttggattggttcataaacaaggacaataaaatcgccgaacagtccaagacctccatcgttagttccttacgcgctagtgtttgataggcttctctaatatagccaaaagcctgataacaagtccatatatagcgaataggagacggtacaaaactacgaaaaagtatacgcttaatcgctgcacctgaaacaatagaataagcactctcttctctacgaatgggaagagtcatcaactcagaaactttccctttatcaattctttttaaaaaggcttctgcattatctaatacagaaaagccttcttttatgcgtagagtaaagtgctgttgatccatgtaaaactggatagactcaatccccttttcatctctcgccaaggaacgaagatagtcttgaatatccaaggtgagtgaaaaagaagatgatagtcggatatgttggtatcctctatgtagcactttaaaagacatattattcccctataaggctatctaattgctcttcttttttctcttgctcgtacaaatatttggcatcttgcaagacatcgtctccatgttgcttcacaacagaaacagatgcatctagctcgtcttttaacttataagccttagccaaagctttagaataaccttttttagcttccttacttgccaagattttcaaaccaagggtaccaaatgcgacaccacccaaaaagagtgatgattttttcgcaacttttgcgacggttaatacttcttttaacatacttatttcctccttatcattattatatagcaatttagatataaaagcaatgtcatttcataaattggagaattatactcaatgaaaatcaaagagcaaactaggaaactagccgcaggctgtacttgagtacggcaaggcgacgttgacgtggtttgaatttgattttcgaagagtattagttttatttctactgaatctcccatctacttattcctaaagttgctttcatttgcctcttttgatacacttaaactatgaatacaaatctcaaacccaaacttcagcgttttgcttctgcgactgcctttgcctgtcccatctgtcaagaaaatctgactctgctagagagtagtctcaaatgtagcaatcgccattcttttgacttggcgaaattcggctatgtcaatctagcacctcaaatcaagcaatctgctaactacgacaaggaaaattttcaaaaccgtcaacaaatcctagaagccggcttttatcaggctatcttagaggctgtatctgacttgctagccagttcagaaactagcaccacagtcttagatatcggttgcggtgaaggtttctattctcgcaaactccaagaaaggcatcctgacaaaaccttctatgcctttgatatttccaaagattccgtccaaatcgctgccaagagcgaacccaactgggcagtcaactggttcgttggtgacttggctcgtcttcctataaaagacgctagcatggatatcctgcttgatatcttttcccctgccaactatggagaatttcgtcgcgttttatccaaagacggtatcttgataaaggttattccaactaaaaatcacctcaaggaaatccgtcagaaggtacaagaccagctgacaaacaaggactattccaaccaagatatcaaaaatcatttccgagaacactttaccatcctatctagtcaaactgcctctctgactaaaactatcacagcagagcagctccaagccctactcagtatgactcctctcctctttcacattgaccagagcaagattgactggagccaactgacagagattaccattgaggctgagattctggttgggagagtactataattgacacaaaaaaccgcatttcaagaagatctgcggttttaaatttcaatttttaaactatctatcccaaaagtctaaaacatttaaagcttttagcttctccatttattttcgattcgaaataaaaaacttatcaataaatagcaagtgaaataaggcaagtgtaattcccgataagcacccatgataagagatttcttgatgggtaagggggtaaagattactattacccgccaagaggcatgttaaaataacaaatagaatccaaaataaatccgtccatttatattttgaaaaatattttttccacataagaacaccttctttcctataatcatattataatactttatgtaagcgaacacaagaaatttgaggtaatttttaagtagatttcgaggcttaaaggttgtaaaaccagcattttaagcgttcaatgtgtctatgatttctctctttttaattcaagattgactcaaatccacagcattcaaaaaaagcgaatttcaatcgaaattcgctttataggaaagtgtattagtataaatcttgtatcttatactcaatgaaaatcaaagagcaaactaggaagctagccgcaggctgtacttgagtacggcaaggcaacgctgacgtggtttgaatttgattttcgaagagtattagttcaagtgccagatatcttcgttatactgagcgattgtacggtcagatgagaagaatcctgctttagaaatgttaacgatgactttatccaaccatgcgtcacggtcttcgtagtcagccaacatttgttctttaaccttgatgtagtcttccaagtcaagaagagtcatgaaccagtctttgttgatcaattcattgtaaagacgttccaagcgctctttgtttccagctgcaagaactgcatcgctaacgatgaagtcaaccaatggtttgatagcttcacgagcgtagaattcgcttgatttgtaagctgcttttgcgtaaaggtcgataacagtttctgaatcttcaccaaagatgtagatgttttcgtcgccaaccaactcagcgatttccacgttagcaccgtccatagtaccaagtgtcaaagctccgttcaacatgaatttcatgttaccagtacctgaagcttctttagaagcaagtgagatttgttctgagatatcacatgctgggataaggaagcttgctgcagtaacgttgtagttttcaaccataactacttgcaagtgtggagctactgctggatcgttagcaataacttctgacatgcaaaggatcaagtggatgatgtcttgagcaattgtgtaggctggagctgctttaccaccaaagaagattgtgattgggcgagcagggatgttaccagctttgatatcaaggtatttgtggattacgtacaaagcgttcatttgttgacgtttgtactcgtgaagacgtttgatttggatatcaaagatagagtttgtattgatttccacaccttggtgttctttcaagtgacgagccaatttacgtttgttgtgaaccttgatgctttccaatttttctttgacagctgctttgtcttcataagacaagagtttttcaagctcatctgcttcatggtgccaaccttctccaataatctcatccaagtagtgagatagtcttgggttagcatgcatgagccaacgacggaaagtgataccgtttgttttgttgttgaatttttctgggtaaaggtcgtagaaagctttcaactcagagttcttcaagatttcagtatgaagtgccgctactccgttaacactgtatccgtagtggatatccatgtgagccatgtgaacacgtccgctctcatcgataatttgaacagctggatctttgtattctgctttcacgcgacgatccaattcttcgatgattggtaccaagtgaggaaccacttcttgcaagaattcaagaggccatttttcaagggcttcagcaaggattgtgtggttagtgtaggcagtcatgctacgaacaattgagatcgcttcgtcaagttcgataccacgagcagtcaaaagacggatcaactcaggaataaccattgatgggtgagtatcgttgatttggacaactgcgtagtcagcaaggtcatgcaagttgcttcctttttcgattgcttcgtcgatgatcaattgcgcaccgtttgaaaccatgaagtattgttggaagatacggagcaattcaccttgacggtcactatcatctgggtaaaggaaaagagtcaagttgcgagcgatatctgtcttgtcaaagttgataccgtctttaatgattgaagaatcaactgaatccaagtcaaacaaacgcaagcggttcttagtttctgtcttgtaaccaggtacatcgatatcgtaaagagttgatgtcaatgtgaagtgagcaaatggcacttggtagctacggcttgagcgaaccaaccagttttgctctgtcagccatgcgtttggaattgtttcttgttggttatttttaagaacttgttggaaaagaccgtagtggtagttaagaccaacaccgtcaccgttcaaaccaagagtagcaattgagtcgataaagcaggcagccaaacgtcccaaaccaccattaccaagagatggttccaattcaacttcttcaacttcgatcaagtctttacctgcagctgcaagttcttttttaacatcgtcgtaaagaccaaggttgatcaagttgtttgacaaaagtttaccaatcaagaactcagctgagatgtagtaaacttttttcttaccagtgttaactggcttttgactacttgcaagcttgctgtagttaagaagagccagataaagctcttcattgctacattctgcaatggttttattgtaacgattttgtacaaattcttgtagtgataacatgtttaaggtgtctcctgatattgtattatttctttaattccaccaaattttcattgattcggcgatagattgttgtcaagtcaagcaagccttcctcgacagctggtgtcaattgatcttcagtcatacgccaagaccagtttccaccaagagtagatgggaagttcatacgagctgcctcatccaattctagcaaatcttgcatagttgcaattgccatgaagctaactgatgaaaagactgtacgaagcatagcatgtggcactgtttcgtattctttacggttagtgtagcgagccatgtattcacgagtcgcatcatcgatctcgttacggtaccaaccaaggaccgtattgttatcgtgtgttcctgtgtacataactgagttagcaggtgccaagtgtgggctatcgatgctttcgtcttctgggttgaatgcaaattgaagaatcttcattcctgggaagcccgtacgttcacgcaattcgataacttcgtctgtcatgaaaccaagatcttctgcgatgatgtttaactcaccaagttcttccttaacggctgcaaaaagcttgtagccagggcctttcacccactcaccaggtgctgctgtatcagaaccagcagggatttcccagtaagattcgaagccacggaagtggtcaatacgaacgatgtcgtagattttgaagctttcacgcaagcgttcaatccaccatttgtagccgtctttgtccattgcttcccagtcatagattgggttaccccaaagctgaccagttgcagaaaattcatctggtgggcatcctgcgatgcaagtagccttaccattgacatcagtcttgaagagatgtggatttgcccacatatcgcttgaatcttccgctacgtagattggcatgtctccaacgatttcgatgtggttgtcgttagcgtaagctttcaatttcaaccattgttggaagaagaagtattgagtcacacggtggtataccaacttgtctgccaattgctcacggtagctttcaagtgctgaagctttacgagcacgagcatctgcatctggccattcagtccaagcaagattgtcaaaatgctctttgatagccatatactctgcaaagagttcaagccatgattggttgtcttgagcaaatttctcaaaatctttaacatctcctacttccaagaaacgttttaccgctttttctaaaagaggacgacgtgcatagtagattttcgcatagtcaacttcagatgcatcgctaccaaagtcaaccccttcaaggtcacttgcttgcaacaagccttgttccaccaagatatctaaatcgataaaatgagtgttccctgcaaaggctgagaaagattggtaaggagaatctccgtaactagttgttcctagtggaaggatttgccagtaacgttgttttgtgcgaaccaagaaatcaacgaagtcgtaagcacttttaccaaatgatccgattccgtatgcccctggaagagaagaaatgtgcatcaacacaccactttgacgttttttcataataagcacctcatgtgtttatagttagatattacatttttatgaacgcaaacgtttgcgctattactagtatagcttattttcttgataaatgcaagcggttttagataactttttttattattttttaaaaaatttttcttcttactcgtatatatattctttcaggaaacaaacaaaataggaataagggtttcacttatctcattaagcaaaaataaagcgagtatcctctctggtttccatttgtaaattaggcaatcgttttctcaacttttttttaaatttaaaacaaaacggatttttgggattttctactattatatgacgatgaagcgtttacttttttcacaattttttaaaaaatttttacaaaaaacacttgcaaccgctttccgattgtgctatactagtcccataaaggaaaacgtttgcgtttcctcattataaaatttgttattctttaggaggaatacactatgtcatctaaattcatgaagagcgctgctgtgcttggaactgttacacttgctagcttgcttttggtagcttgcggaagcaaaactgctgataagcctgctgattctggttcatctgaagcgaaagaactcactgtatatgtagacgagggatataagagctatattgaagaggttgctaaagcttatgaaaaagaaactggagtaaaagtcactcttaaaactggtgatgctctaggaggtcttgataaactttctcttgacaaccaatctggtaatgtccctgatgttatgatggctccatacgaccgtgtaggtagccttggttctgacggacaactttcagaagtgaaattgagcgatggtgctaaaacagacgacacaactaaatctcttgtaacagctgctaatggtaaagtttacggtgctcctgccgttatcgagtcacttgttatgtactacaacaaagacttgataaaagaagctccaaaaacttttgctgacttagaaaaccttgctaaagatagcaaatatgccttcgctggtgaagatggaaaaacttctgctttcctagctgactggacaaacttctactatgcatacggacttcttgctggtaacggcgcttacgtattcggtcaaaacggtaaggacgctaaagatatcggtcttgccaacgacggcgctatcaaaggtatagaatacgctaaatcttggtatgaaaaatggcctaaaggtatgcaagatacggaaggtgctggcaacttaatccaaactcatttccaagaaggtaaaacagctgctatcatcgacggaccttggaaagcccaagccttcaaagatgctaaagtaaactacggtgttgcgactatcccaactcttccaaacggaaaagaatatgctgcatttggtggtggtaaagcttgggtcatccctcaagccactaagaaccttgaagcttctcaaaaatttgtagacttccttgtttcaactgaacaacaaaaagtattatacgataagactaacgaaatcccagctaacactgaggctcgttcatacgctgaaggtaaaaacgatgagttgacaacagctgttatcaaacagttcaagaacgctcaaccaatgccaaacatctctcaaatgtctgcagtttgggatccagcgaaaaatatgctctttgatgctgtaagtggtaagaaagatgcgaaaacagctgctaacgacgctgtaacattgatcaaagaaacaatcaaacaaaaatttggtgaataaaaaatttgttcaaggggggtggaattcaaatccccctttgaatttatcaatagaaaacatatatagtttaggttttaattagaaaccagtatcctatgaaaggagttattatggaaaagcaacaacctagtaaagcagccctgctgtctatcattcctgggttaggacagatttacaataaacaaaaagcaaaaggttttatcttccttggtgtaacccttgtatttctcctctacttcctagcacttgcagcccctgaattgagtaatctcatcactcttggtgacaaaccaggtcgtgacaattccctctttatgctgattcgtggtgccttccatttaatctttgtagttgtttatgtactcttttatttcgcaaatatcaaagatgcacatacaactgccaaacacattaacaatggcataccagtagcacttacctttaaagaaatggtcaaaggaatctatgaaaatggcttcccttacctcttgatcattccatcttatgttgccatgacttttgcgatcatcttcccagttatcgtaaccttgatgatcgcctttaccaactacgacttccaacacttgccaccaaacaaattgttggactgggttggtttgacaaactttacgaacatctggagtttgagtaccttccgttctgccttcggtgccgttctttcttggactatcatctgggctttatctgcctcaactttacagatcgtgattggtatcttcacagctatcattgctaaccaaccatttatcaaaggaaaacgtatctttggtgttattttccttcttccttgggctgtcccagccttcatcactatcttgacattctcaaatatgtttaacgatagtgtcggagccatcaacactcaagtcttgccaatcttggctaaatttcttcctttccttgatggtgctcttattccttggaaaacagacccaacttggacaaaaattgccttgattatgatgcaaggttggcttggattcccatacatctacgttttgactttaggtatcttgcaatctattcctaacgacctttacgaagcagcttatattgacggtgccaatgcttggcaaaaattccgcaacatcactttcccaatgatcttggctgttgcagcacctactttgattagtcaatacaccttcaactttaacaacttctctatcatgtacctcttcaatggtggaggacctggtagtgtcggaggtggagctggttcaaccgatatcttgatctcatggatctaccgtttgacaacaggtacatctcctcaatactcaatggcggcagctgttaccttgattatctctatcattgtcatctcaatctctatgatcgcattcaagaaactacacgcatttgatatggaggacgtctaagatgaataactcaattaaactcaaacgtagactgactcaaacccttacttacctctacttaattggcctatcaatcgtgattatctatccacttttgattaccatcatgtcagcctttaaagcaggtaacgtcgcggcctttaaactcgatactaatatcgacctcaattttgataactttaaaggcctcttcactgaaaccttgtacggtacttggtatctcaacactttgattatcgccttaattactatggctgttcaaacaagtattatcgtacttgctggttatgcttacagccgttacaacttcttggctcgtaaacaaagtttggtcttcttcttgattatccaaatggttccaacaatggccgctttgacagccttcttcgttatggcacttatgttgaacgcccttaaccacagctggttcctcatcttcctctacgttggtggtggtatcccaatgaatgcttggctcatgaagggctacttcgatacagtgccaatgtctctagacgaatctgcaaaactagacggtgcaggacacttccgccgcttctggcaaattgttcttccacttgttcgcccaatggttgccgtacaagctctctgggccttcatgggaccttttggagactatatcctctctagtttcttgcttcgtgagaaagaatactttactgttgccgtaggtctccaaaccttcgttagcaatgtgaaaaacatgaagattgcctacttctcagcaggtgctatcctcatcgcccttccaatctgtattctcttcttcttcctacaaaagaactttgtttcaggacttacaagtggtggcgacaagggataatatatccccgccaccctttttcattttatactcttcgaaaacctcttcaaaccacgtcagcttccatctgcaacctcaaaacactgttttgagcaacctgcggctagcttcctagtttgctctttgattttcattgagtattagcgattgttactgtaagtaatatccttacaacaagcaatttttctcctagacttgaaataaagcacatttctctatataataatactcatatagaaaacaccttttagaaagatacaaatgactccatatccattttcctatttttcaagtatttggggatttcgtaagcccctgtccaaacgtttcgggctcaactggtttcagcttctctttaccagtatcttccttatcagcttatctatggtacctattgccatccaaaacagctcgcaggagacttatccgctagaaacctttatcgataatgtctatgaaccattgacagataaggttgtacaggatctctctgaacacgctacaattgttgatggcaaattaacttatactggaacatctagtcaagcgccttctattgtgatcggtccaagtcaaagcaaggaattacctaaggacttgcaactgcatttcgatacgaatgagctcgtcatcagcaaggaaagtaaagagctgacccgtatctcttaccgagcgattgagactgagagtttcaaaagtaaagacagcttgacccaagccatttctaaagactggtatcagcaaaatcgtgtctatatcagtctcttcctagttctcggtgcgagcttcctctttggtttgaatttctttattgtctctctaggagcgagtcttctcctttatatcactaagaaatcacgcctcttttcatttaggacctttaaagagtgctaccattttatcttgaactgtttaggattacctactctgattacgcttattttgggactatttggccaaaatatgacaactctcattactgtacaaaacattctttttgttctgtatctggtcactatcttttataaaacgcatttccgtgatccagattaccataaataggagatttttatgcccgttacgattaaagacgtggccaaggctgctggtgtttcgccttcaaccgtaacccgtgttattcaaaacaaatcaaccattagcgacgaaacaaaaaaacgtgttcgcaaggctatgaaggagctcaattaccaccccaacctcaacgctcgtagtttggtaagcagttatacccaagttatcggcttggtccttcctgacgactcagacgccttctatcaaaatcctttcttcccatctgtcctccgtggtatcgcccaagtcgcatctgaaaaccactatgcaattcagattgcaacaggtaaagatgaaaaagagcgccttaaagcgatctcacagatggtttacggcaaacgtgtagatggtttgatcttcctttatgccgaagaggaggatcccttggtcaagctggtcgctgatgagcagttccccttcctcatcctaggcaaatccatttcaccctttatccctcttgtagataatgacaatgtccaagctggttttgatgcaaccgaatattttatcaaaaaaggctgcaaacgaattgccttcattggaggaactaagcgactcttcgtaacgcaagaccgtttaacaggctatgagtcagcactcaaacaataccaactgcctattgacggaaatttgacctattttgcaacggagttcttagaagaaaaagggtatcagtttagccaactcctctttcagcatgacccacagattgatgctatcattacaaccgatagtctcctagctgagggggtctgtgactatatcgctaagcaccaactggatgtccctgttctcagctttgactcggtcaatcccaagctcaacttggcggcctatgttgatatcaatagcctagaacttggtcgtgtttcccttgaaactatcctccagattatcaacgatgctaaaagcaataaacaaatttgttatcgccagttgattgcccacaaaattatcgaaaaataaaaaccagctcgagctggttttttttagttactaattttctgtttcaacgaatcgtcccaaaatatgaacattctcagatacagagacaaaggcacctggatccacctgtttcataatctgtttaaattcattaaacactgcacgtgtaatgacagtgattaaaactgcctttctttcgtgattataggttccttctgcatcgtggatcatggttgctccgcggtgcaattttttatgtattttttcaattaccttgtctggatgattggtcacaatcatggcctgcatgcgtttttgcttggtaaagaccgcatctgtcacacggctagagacaaagatggtaatcatagagtagagagcgtatttccaaccaaaggtcaaacctgctatcagcatgatggtcccattgaccaagaaagaaatactaccaacattcttacctgttttcttgcgaatggtcaggctaacgatatccgttccaccactggagatattgtttcgaagagcaaaaccaatccccaagcccatgacaacacccccaaaaagggcattgataatgggatcctccgtcaaggtcgccacagggacaaactggataaagaaggaactcatggataccgtgataaaggtaaagacggtgaacttatggccaatctgataccaagccaagaccatcaaaggaaaattaatggcgtagaaggtcagcgaaatcgggatatgaaaaccaaaccagtgattactcaaggcagagataatctgtgccagacctgttgcaccactcgaatacacatgccctggttggaaaaagaaattgaccgccactgctgataaaaaaccatagaccagagaggccgaaatcttctcatcatacttttcgcgagagatactttgtaagacacgtaaaatttttatctgatgagcaaagcggcgcaaataatagcgccaccgcttaattcgttttgcttgtttcatcttcttctacttgtaagctgagttcctctagttgtttgagagctactgttgaaggagcttgtgtcattgggtcagttgccttgttgttcttaggaaaggcaatgacttcacggatattttcttctccagcaagcaacataacaaatcggtcaagcccgatagccaaaccaccatgtggtgggaaaccatagtccatggcttcaagaaggaagccaaactggtcatttgcttcttcagctgagaaaccaagagccttgaacatgcgttcttgaaggtctttttgattgatacgaaggctaccaccaccaagctcataaccgttcaagacaatatcgtaagcaatggcacgaaccttggccaaatcaccttctaattcgtgagcagtctcttcctgtggaagtgtgaatggatggtgggcactcatgtaacggccttcttcttcagaccattcaaacattggccagtcaaccacccaaaggaagttgaatttatcgttatcaatcaagccaagctctttggcaatacgtccacgaagggcaccaagagttgcattggccacttcaagcgtatccgccacaaagagaaccaagtccttatcttcaagagcaagcgctgttgtcaattctgcttggatgctagtcaagaacttggcaactggtccgtttaattctccatcaaccaccttgacccaagcaagacctttggcaccatactgtttggctacttcggtcatcttgtcgatgtctttacgtgaatagttgtccgcagctcctttgaccacaattgcttttacagcaggtgcttctgaaaagactttaaagtctacacctttgactactgctgtcaggtcctgaagcaacatgtcaaaacgggtatctggcttgtcagaaccgtaaagagccatagcatcatcatatttcatacgaggaaatggaagcgtcacttcgatgcctttagtttctttcatcacgcgcgcaatcaaaccttctgtgatatcttggatttcttgttcagtaaggaaagacgtttccaagtcaacctgggtaaactcaggctggcggtcaccacgcaagtcctcgtcacggaaacatttaacgatttgatagtaacggtcaaaaccagcattcatcaagagctgtttcgtgatttgtggactttgaggaagcgcgtaaaaatgccctttattaacacgagacggcaccaagtagtcacgcgccccttcaggagttgacttagaaaggaatggtgtctccacgtcaataaactccaactcatccaagtagttgcggatagagtgggtcaccttggcacgaagtttaagattttccaacatttctggacgacgaaggtcaaggtaacggtaacgcaaacgtgtatcgtcattggcctcaatgccatccttaatctcaaatggggttgttttagctgtattcagtactgtcagagctgtcacgtttagctcgactgcaccagttggcaacttatcattggcttgctcacgcgcagcgacctgtccagtcacctcgataacaaattcgctacgaaggctttcagctgttgccatgacctctgcagatactttttcagggttgataaccaactgcataattccttcacggtcacgaagatcgataaagatcaaaccaccaaggtcacgacgacggccaacccatcctttcaaggttatttcttgtccgatgtgttcctcacgaacacgaccagcatacatactacgtttcattgtttctctcctcttttattctgttactattttaccataaaagcgcaggctcttcatgaaaatcatcagaaaagtttgccagtctttaaaaatcaagtgaagactctaaaaattgacgcccatacaaaaatccgatgaagttcatcggactcttttattttgaattgttgcctgctttacgcttttcagcaatttcggctgcctttcgaggcaagacaatttccgttgtgtaagctgtcccaaagcgcaagacacctgcaataggggcaaagacgactgctagatagttatagaagaaatcgcccttaaaggcataagctagcgctccaatgatgaaaaatagaacaactgcctgaatcactgctaataaaattactcgtttcatgtgacctcctgactctattatagcatgagaatcatcaaaaagccgactaaattatttaaagcgtgaagagaaatactgtagaccagaccttttctgctaatataagccaagcccaagctaaaaccaagactagcataaactaaaaattgttgcacatctcctgggaaatgaatcaaggcaaacagaacactagttaccagaagaaaaattagagtttgtttactattgtcctgcttaggaaagaggtagcgtgctaacatccctctaaagataagttcttccgtcaaaggagcaaaaataacgaccgcaaagaaggagaagagtggctgagccaaggtcaagtctgtcgccatttgttgatttaccgaaggatcatctggcaagaaaaactggacaagcagagataagaaccaaaccagagcaggaagccaaataaatcggttgaagccactcttctcaatatgaacaggacctttctgataccatttataaatgacgtacacatatactccagccaaggccacataaagcaaggtagtagcatagggtgaagcgcctagattcaaagcttctacagccccactctgaacggtaccatagataaacacaaaggatagaatggctagaagaaaccagccaaggtttttaagtagtttcatagataactcctatttgaaatagcgttttaccataggtaactgcatcacattgatataaatatggattgctcctacaagcaagaagcccagtagttgaatctctcctgtcaataaagaaaagagatcgatcagaaagtagagacctggcaagacatagttatttaattggaataaaatccgaaaactctgttccaaattagccttgcgctccccttcatcgtaagaatcgaaatagtccaagacatcctttggcgtagagaaaaatgccaaatcaaactgacgaacaatcgcaatggtcttaaaaagatatttttgaacattgaaaaccaacactaatagcaaaaaagaaagagataaggttagaaagcttccatttagtataatcacttcacttcctgcaatgaagagagccaataaaattgctacgtttgcaatattaaaagcaatggttccaaactcaagatcacgatacatttgcacataataggtctcattcagatcatcatccatttcctcttgatacaaggagtgaaattttctgcttttctttaagaaattgaacgtcaaaagaatgctaatgaaacctatcagtaaacaaatagctgatatccatggtaccaagacttttacatctaacataattccgtgggattcggcacgtgctttaaacatccctacaaacatgcccaagaaagctcccaagacaacagacattaaaaataacaatccatgcttctttttcatattcattctccttattcacttgctaaatttttggatttcttttcaatccagtcgattactggtatgagggcaaaataggcccaaataaattggtcactctgatagggactaaaccagcctaagtctatcccaatcaatagaaatatgctgactaatagagctgcgacaactacataataaaccactttatacttgttcatcactcgtcctcctccaagcgaaataccgattcgactgtttcgttgaaaatttgagatattttcagggcaatgataatggacggggtgtattcatcccgttctaatagactaatggtctgtctggaaactcctgccagcttagctagttcggtttgattgaaaccatcgcgagctcgcagctcttttagacggttttttagttgcatgttacacacctactctccgtcaaattcaacggcttggatatcctcaatacgttgcaacttgaatttttctttcccatttttatcgacatgacgtagtttgacccattcctcatcaacatccacaacttcccataaagatgttccaaacacttgtccaacgattgttggatttttcccaaattaattcttgcaataatcttgacatatctatatttcctttctcttttctttcgattacctttaacctcttctctaaccgcttgatttttttagattgactactataaatcaagacgagaaaagggaaaaaaatccatacccacatgtggctccctcctatttctttatttcttaacttgaatttattgtaacacatctttttctttttgacaagcatatttgtcaaaaagtttatgatttttgtcattttgcaaaagaaaaaggtcaggattaggttcctgaccagtttatctatcattaaaatcctagtttttcaaagatttctgagaagttttggctgattgtctcaagtgacacttgcacttcttctcgagtttggttgttcttgaccgttacttgtccgctttcgacttcactctctcctagggtgatgagggtcttagccgcaaagacatcagctgacttgaactgagctttgagcttacggttgaggtaatcacgctctgctttgaatccttgttggcgaagagcctgtaccaattccaaggccttgacatttgctccatcacccaagactgcgatatagacatctagggcgttttcgatagggagagccacaccttgcttttcaagaatgagaagcaggcgctctacaccaagtccaaaaccaaatccagcagtttcagggcctccaaagtaagaaaccaaaccatcgtagcgaccacccgcacagactgtcaagtcattgccctcaatctcagtaatgaactcgaaaatggtgtggttgtagtagtccagaccacgcaccatattggtatcgatgatatagtctactccaagattttccaacatctgacgcacagcatcaaagtgtgcttggctttcttcatcaaggaagtctaagatagaaggcgcattctcgactgctaccttgtcttctttctccttagagtccaagacacgaagaggattttcctccaagcgacgctggctatccttagacaaggtctccttgagcggtgtcaaatagtcaatcaaggcttgacggtaggccgcacggctctcaggatttccaagagtgttaaggtgcaatttgacaccttggatgccgatttctttcaagaaatgggctgccatcgcgatggtttccacatcggtagctggattactagagccaaagcactcgacaccaatctggtggaactggcgcaaacgtcctgcctgtggacgctcatagcggaacataggtcccatgtagtagaacttacttggcttttgcacttctggggcgaagagtttattttccacataggaacggacaactggcgcagttccttctggacggagggtgatatgacggtcacccttatcataaaagtcatacatttccttagttacgatatccgttgtatctccgacagagcgactgataacctcgtaatgctcaaaaatgggcgtgcgcacttctgcgtagttgtagcgcttgaaaatctcacgggcaaagccctcaacatactgccacttggcagactcagcaggtaaaatatcctgcgttccttttggtttttgtaatttcatagggaatcctctttaaacttaatagtcttattttaccataaatagagggattaaaacagtgagaaaaaaattaggatttagatatcatttttgagattaataactgtcaaaagaatagctagcaaggaaagaccaacaaatagcatccaagtcaactgtatattccatacagctacaagtgaaaaacaggctgttcccacaggtatggataaggtaaacaataaacctaaaaaattactggtacgagctagaacttctggagctagatttttcataagcatggcactaatctttggttgaactttaccagacacatacagagttgaaaagagaaatagtaaaccaagtacgacttgattgaataaattagctagaccaactagactgagtcctacggtcacccacatcatcaatctaggcaaggactgcttcccaaaataatcattgcccgtaaggctactgatgatgattgctaacaaagcacagacttgactgataaataatgcctctgtgtaagaaaagtccaaaagagaatggctcaaaaagaagatgttatagatgcttcctaaagcgccacccaaggcattgataagcaagacagcaaagatcatgaatccaaagtttttctgtccacctttaagaaaaacgagacgtaaatttcggtaaattgttaggaactggtctttgatagaaagcttctcattttttagaattttaccatcagcagatgacattgacaggctcaatttgctttttcctaaaaagaggataacggctgatactaggaaaaaacaggcattgattcccgcaacgagagaaaaattattgaccgatagccctaagagccagactccgaaagcttgaccaccaatagctgaaatataggtgatgaactgggaaaaagaataagcctccatcagatcatcttcagctactttttccttaataagaggcatgcgcaagccacctgcaaaatcactgataacatcactaatgacattgattaaacacaggctagaaaaggcaaataaactagcttgctgaacaactagggctgccagaaaaaataaaaccgcctgaaacaaaccgctgtaagtcatccatttgaccttgtccctcgtgtaatctgcccgaatccctacaaaaactgtaaagaaagtcggaagaatcatgacaatattcgccatagcaaccgcaaaagaggcttgtggcagggtcgatgcatagacgataaataccaggttaaaaattgaagcaccaaaggcattgaagaagcgtgacaaagtcaagagtcgataagcttgatttctaaacaatagtttcataggtaatctcccttcttgttcaaatact

SEQ ID NO: 72 - DNA, 124845 bp, Streptococcus mitis NCTC 12261 contig18
tgatactcaatgaaratcaagagcaaactaggaagctagccgcaggttgctcaaaacattgttttgaggttgcagatagaagctgacacggtttgaagagattttcgaagagtataagtaggctgaaaaggctccagccacagcatggactattataacacattcaggaaagagaaaaaagtctgctgattgtaatcagacagactccattttattccatagtatcaaaggcaagacttggtttggcattgaggtccaagtttgcaaaattttctttgttccactcgctgacgctggcataggcaatcattcctgcattgtctccacaaagacgcagtggtgggatgatgaccttgacatctgtgatttcggccgctaggcgttctctgagacctttattggctgccacgccacctgccacaaccagggttttaacagggtattttcccaaggccttcttggtttttgccataagaatatccaagacagctgcttgaaaggaagcacacaaatcctctgtggacaagctttctcccttttgctcggcattgtggtgaagattgataaaggccgatttcaaacctgagaatgaaaactccagattatcttccttaatcatggcacgagggaaatcataaatatcctgtccctgatgagctagctcgtcaatctcacgaccagcaggataggtcaaacccatgacacggccaaccttatcataggcctcaccaaccgcgtcatctcgcgtttccccaacaatcttgtagtcaccagcctccgaaacataaaccaactctgtgtgcccaccgctaaccaagagggctagcaagggaaactccaaaggctccacactctgagcggccatgaggtggccagccatgtggttaacgggaatcagcggaagcccatgtgcccaagcaaaagccttggcagctgacaaaccaactagtaaggctccgaccaagcccggtccataggtaaccgccacagctgttacgtcctcttcggtaattcctgcttctgctagagcctcctcgatacaggctgtaatgacctcgacatggtgacgactagctacttctggcactacgcccccaaaacgtttgtggctctcgatttgactagcaatgacattggacaagagctggtcgtctttttttaagacagcgacactggtctcatcacaggatgtctcaaatgctaaaatatatctatccttcatctatttctctcttcatgatgatggcgtcctcgactgggtcatggtagtaggcctttcgctcagcgatgactgccatcttttctttcttgtaaaatgcttgcgctctttgatttgactttctaacttcgagaaaaatctccttgtctgtcggcaattgagcaaacaaggtcgaggcaatcccctgaccctgataggctcctttaacagcgatttgcaggacttctgcctcaaagatattttcctgcacagctagaaagccaatcacttctgccccatcataagccagagcataccaagtctggtcttgggacaggtctgcttggatttgttccagagtccaaggactgactgggtaaacagttaccatgacagcgtagatggcttgagccaagtcaggctgttgttggattcgtttgatttctatcataggcgtttaatgtaagactcgccagactcggtgtgattcttgagccagttttcctcagcctcaacacgtttgaggtagttcggcacaaaatcatgcaaggagtctgcttccttgtcccaagccaaaagagcaagattagctgcatttggcagggtttctttgtaattagtccttggcaagtgttcttgaatctgctccacaaagggggcaacttctccgacaaaggtaacctgactagcccccttgattaactcaatcactcgctcaaagggtaagtgcgcttctggcatgacagacttagcattttcataaaatcctgcataaacattgttgcgacgcgcatccatcaaaggaacgaacaaaccttcttgttggtagggcaccaaagccaagaggctagacataccaaccaactcaatgttcagagtatgagcaagtgtcttagcagttgctaccgcaattcgcaaacctgtgtagctacctggcccttccgccaccacgattcggtccaaatccttgggcgtccaatccaaacttgccatcaaaaaatcaatggctggcatgagggtaatactgtgatttttcttgatattaatcgtcgtctcggcaagaacctgcttgtcctctaaaatagcgagagaaagagccttgctggacgtatcaaaagctaatactttcataacacattcctatctttttgtctgcttactattatactacaaaagctggcacatgggaattttctttatccccaaacaaaaatgccccagcatgagcagggcatctaagcatttaatccaaagtaaaatacaaaccaaacgacataggttacaaggaggagaaaaagcgagtagagagtcacaaaggtaatcttccacaagaacttggtttgtcgttgttccagtttggcaaatagaagattccccgcataaacgcaagcaacaaaaacaataaaagctaccaagcgagctccgatagcaaaagcaaataagttatacatagggcaacctccttgacttaaaatctatatggaattatgacaaacaataaaactcatttccattatcaaaataacatattttctttatttttgcaaacgtttactaaagaaatcgtcctgtgactttctcgtttccgtcttttactaatttttcattttgtggtataattgaaataattgtaacgaatcaaggtcaatctagacacaaaatggaatgaaattaagcaaatttatgctaaaagtttggaataagctgacctgtaaatagaaaggaactatatgatttacaaagttttttatcaagaaacaaaagaacgtagcccacgccgtgaaacaacacgcgcactatacctagacatcgatgctaactcagaacttgagggccgtatcgctgctcgccaacttgtcgaagaaaatcgcccagagtacaatatcgagtatatcgaactcttgtctgacaaattgctagattacgaaaaagaaactggcgccttcgaaattacggagttctaatatggcctacactcttaaacctgaagaagtcggcgtttttgccatcggtggtctgggagaaatcgggaaaaacacttacgggattgaataccaagacgagattatcatcgtcgatgctgggattaaattcccagaagatgacttgctgggtatcgactatgtcattcctgactactcatacatcgtggacaatatcgaccgcgtcaaggctgtcttaatcacacacggacacgaagaccacatcggtgggattccattcctgctcaaacaagcaaatgtccctatctatgctggaccgcttgccttagctttaatccgtgggaaactcgaagaacacggcctcttacgcaacgccaaactttacgaaatcaaccataatactgagttgacctttaaaaatctcaaggcaactttctttagaacgactcactctattccagagcctttgggaattgtcattcatactcctcaaggaaaaatcgtctgtacgggtgactttaagttcgacttcactccagttggagaacctgcggacttgcaccgtatggctgcccttggtgaagaaggtgttctctgtctcctgtctgactcaacaaatgcagaagtgccaacctttaccaactctgaaaaagtcgttggccagtccatcatgaagattatccaaggcattgaaggacgtattatctttgcatcctttgcttcaaatatcttccgtctccaacaagcaacagaagctgctgttaagactggacgtaagattgcggtctttggtcgttctatggaaaaggccattgtcaacggaatcgagcttggctacatcaaagctcctaagggaacctttatcgagccaaatgaaatcaaagactaccctgcaggcgaggttctgattctctgtacaggtagtcagggtgaaccgatggcggccctctctcgtatcgccaacggaacccaccgtcaggtgcaactccaacccggcgataccgttatcttctcttctagtccaatccctggaaacactactagcgtcaacaagctgattaacatcatttcagaagctggtgtcgaagttatccacggtaaggttaacaatatccatacatctggacacggtggccagcaagagcaaaaactcatgctccgcttgattaagccaaaatacttcatgcctgtccacggtgaataccgcatgcaaaaagtccacgctggactagcggtggatactggtgttgagaaggacaatatctttatcatgagcaatggtgatgtgcttgctcttactgctgactcagctcgtatagcaggtcatttcaacgcccaagacatctatgtagatggaaatcgtatcggtgaaatcggtgctgctgtcctcaaagatcgtcgcgatctatctgaagacggtgtcgttctggcagtcgcaactgttgacttcaaatcgcagatgattctgtctggtccagacatcctcagccgaggctttgtctacatgagagagtctggcgacttgattcgccaaagccagcgtatcctcttcaatgccattcgtatcgcactgaaaaacaaggatgctagcgtgcaatcagtcaatggtgccattgtcaacgctattcgccccttcctttatgaaaatacagaacgtgaaccgatcatcatccctatgatcctcacaccagatgaagaataaagcaagaaaacagccccgtcttcggagctgtttttttctatgctttcttttcttgatttttagaaatactacgatttttaccttccagatacaccatcaaaatagaaatgtctgctgggtttactcccgagatacggctggcttggccgatggtttctggattgataagtttgaacttctgacgggcttcggttgcgatagaatcaatgtcatcccagtcgatattggctggaatgcgcttttcttccatgcgtttcatcttggcaacctggtccatggctttggaaatatagccttcgtacttgatttctgtttcaatcaattcgataatcttgtcatccaagtcctctgctgctggtccgatgaaggccaccacatcttggtaagacacttctggacggcgaaggaattccttggctgtcactgcatcggtcaacggcttgaatcccatctcctcaaccttagcattggtttccttgactggcttgagtttgatactgtctaggcgcttcatctcattgtcaaattgatttttcttgatttcaaaacgagcccaacgttcatcatccacaagcccaatctcacgtcccatctcagtcaaacgcatatcagcattgtcatgacgaagaatgagacggtactcggcacgactagtcaaaaggcgataaggctcaatggttcctttggtcaccaagtcatcaatcatgaccccgatataaccgtcactgcgcttcaaaatcaattcaggcttgccttggattttcagagccgcattaatacccgcgataatcccttggccagcagcttcttcataacctgacgttccatttgtctgaccagcagtgaaaagacctgagattttcttggtttccagagttgcacgcaactgatgaggcaagaccatatcatactcaatggcataacctgtccgcatcatctctgcattttccaaacctttgatggaatgaaccaagtcacgctggacatcctcaggcagactggttgaaagtccttgaacatagacttcctctgtattgcgcccttctggctcaaggaagagctggtgacgttccttgtccgcaaagcgtacaatcttgtcctcaatcgacggacagtaacgaggtcccactcccttgaccacacctgtaaacataggcgcacggtggaggttgttttgaataatctcatgactggtaccattggtataggtcaaccagcatggcacctgatctttgacataatcctcatcacgtgaagtatatgagaaatgattaggcgcttcgtctcctggctgaatctctgtcacatcgtagttgattgaagaagccttgacacgtggaggggttcctgtcttgaaccgaccgatttctaggcccaattccttgagattatcagcaaggttaatagaagctaggctgtggttaggacctgatgagtacttgagatctccgatgataatttccccacggagggcggtccctgtcgtcacgataacagccttggcagcatactcttgatgggtcgctgtacgaacaccgacaactttgccgtcttcaaccaaaatctcatcaatcatagtctgacgaagggtcagattttcttgattttcaaccgtcttgcgcatttccttagagtaaagctccttgtcagcctgcgcacggagggcacggacagctggccccttccctgtgttgagcatcttcatctggatgtaagtcttgtcaatggttttggccatctcgccaccgagggcatcaacttcacgcacaacaatccctttggcagaaccaccgatagagggattgcaaggcatgaaagccagcatttcaatgttgatagtcgcaagcaaaaccttacaacccatacggctagcagctaaggaagcctcgaccccagcgtgtcccgcaccaattacaataatatcgtattcttctgtaaaattatatgtcatttcttaacctttcaaaaatttctcgtaaataaggaactaacttctcctcctctagagcttgagccatagtaacccatttaaagtgcgtatgctcttcaggatctaatctgataattggcttctccccaacccactctgctttataaactaatcgagtaaagacagtatccttagaagtatccagttgactatcttcgtgaagaagtttgagcaaactgctatctagcctaactcccgcttcttcaatacattctctaagagctccatctcgcggaagttcacccttttcaaccccgccaccaggaatatcccagtaagttggataaacattgggttgtcctcttttaatttccgaacgctgaatgagcaaataatcatctccactatgaacaagtacatgggcaataagcttaaccatccttttctctcctatttctcaagatgaatgtgtcttagttggccgtcccaagttggtagggctgtttttaaaaaggctggaactagctggatattctggagttcatccaagtcaatccactcacaaggctgcattttttcgtcttcctgcatggtcaatggggcatcctcaagcaagttcaccagataatgaaactcgatgttgtgataggaaacaccgtcttgttcaaaacgattttcaaccacaaaagctagctgcccagcttgagctttaacacccagttcttccctcacttcacggactactgcgtcttccgtactttcattgacttggatggcaccgccaatagtgtaatacttgcccttatctttggtgactagaagcttgctattttggagaatcaaggctgtcgcccgaacaccaaaaactgtatttcctacttttatcctaaagtcttgctgagtcattttttcctttcccttaaacgacacaaaaacagtcaaaactccaaagaagtgcaggacaaaaaagcctgcaacatccatgagctttgaccatcatttctattgcttttattattgtagcaaattgagaaaatttgtcaatctaaatgtactgacaaacttgtccatcgcggtaggcattgtcaatcaaaccaccacctagacactcttccccgtcgtaaaagacaactgcctgacctggtgtgatggcgcgttgcggttctgcaaagataacctctgccttgtctcctttgacatggacggtcaccttagaatcaggctgacggtagcggaatttagccgtacattcgagcgtaaactcctctggcatgtcacgagtaaagtgaacttgactagcctcaaggctggttgacatgagcgaatcatggtagaaaccttgtccgacatagagaatattcttgcttagatcttttccgacaacgaaccacggcgcgttgtcaccaccgtgttgaccaccgataccgagacctccacgctgaccgattgtataatacataagtcctgcatgctcgcccatatcgcgactatctacagtcatcatgcgaccaggctgagctggcaggtagttgctgaggaaatttttaaagttcttttctccaataaagcaaatccctgttgagtctttcttcttagcagtcgcaaggcctgcttcttctgctagttttcgaacttcaggcttttccaaatgtcctagtgggaacatggttttttggagttgttcttgcgacagttggctgaggaaataggtctgatccttgccattatccacaccgcgaagcatgtgaacagtgccatcctcatcacgcgccactcgggcataatgcccagtcgctacatagtctgcccccaaggtcatggcatagtccaaaaaggccttgaacttgatttccttgttgcacataacatctggatttggcgtgcgtcctgcacggtattccgctaggaaatactcaaaaacgctgtcccagtactctttttcaaaattgacagagtagtaaggaatgccgatctggtctgctaccgcagccacatccttgtaatcttcggtcgccgtacagacgccgttttcatctgtgtcgtcccagttcttcatgaagataccgatcacatcgtagccctgctccttgagaagaagagctgtcaccgacgaatcaacaccaccactcatccctacgacaacacgtgttttagagttctcactcatggtaagtctcccatctattcgtttattcacgattgaaggtcgtgtgtgcttaacgattgaaggtcgcttgagcagtattcattataacatgcttggttggagaagacaagaaagaggatgtcaatcgaccaacctctttgtaaatacatatataattgtttaaaaagagggtaatttatagcttaatccctctactgcttattatcttatttataaaataaactaaaaatgatatactatattgaggaggaatacgtacatgatcccttaaagatactaccatccatgtacgtagaacgattgtgaaaaactacaaagatattctaaaatcaaaaaataccatttttactattatcattgtcgcaagtattggacttttaattggtctagtcattcaccaagaaaacatcttaacagaaagaggcaatattgctttcttcaaacggcaaaaaaatgaacaagatgtcgaacaagtaaaaaaagccatcaaagattttaatatcgattctgaaacaattatagaagattggaaaagaattcaagaattgaagccaaacactgacgaaggcaagcaaacattagcagactttcttactactacgtccgataaaatcaccaatcattatagcgaaaaagctttaaaaatggatataaaggaatccgatagtcagtttgaagataaacaaacacttgaaacagccatcacttccttacaaaaaatactagaaatcattaaaagtgttaactccacaagcgaacaagccactattgatgaaaaaataaaacccatccaagaactaatttctaaattccaaaagcaagttgaagtcttgaccaaaaaagaaggacaaaagactgacaaaaaagaaacaggaacgactagtagcgagggggaaagagaaacctattcttcaggaggagggagctacactccaacctatactgagtcaaatgggagcagatacagttcacaagcgcctgcaagcgaaccaccttcatctaatagtgctggcagcagcggaaatgatgtggcaagtacacaaaatcaagcagctaatacttcagaagctcaagcagaaactaataccaatagtaacaatgctgaagttcccacaataaacagtgatgatctcgctagtttaggtggcggagttacatcattcggtcagcagtaagcaatcggctatcactaatttaattgtcttttatcgaacaaagtatataaaagtctaacaaaaactaacttctaaataaaaccacacagtcattccaatattgaacataatcaaattgaaagggatactgtgtggtttttgaattgttgaacattcagagattccatttttggggcaattgtctatcaaaatgtccttttatctgtcaataatcctaaaaaatcttgtcgtttcaagtcggagaaatgtttggcggaaagacttcccttttgaagtccatcatctctgacctgcaaataatagctatgttggcttgttttaatcgtcaaaaagtctccaaatacaaaagctcttttccagttgcgaatctcaaattcttttatctctgatttgggaatacggataagtccttgtcgcaaatcacgatgatgctcacttgtgaaagtcatcccatttccaagatttcttatcagcagttcatctggagttaccatcaccagcgctattttagttaagaaaatttcaactgttggtggtaaaatcgccaaatcaaaccaaggatgtaggtagcgataggctaagaaataatgaggctcctcacccaatcctagttgtttatacaaggtcttgacttcactatctaacctcgcttcaaaagacacatccgaatgctcttcttccttcctctgattaacataacgcatccagactaggaaacctataaagactaggacaaatattcctgataaaagatattttaaattgtagttcatcgcttaacctcctgattcacacctctgcctaaaacagaagcctatttattttgaaaataggtccatcataactttaaataagacgggtgtcattaaaattaggataattcctatcacaaatatcatgactactcgaaaaagttccttatttttaaacatttttccaccccttttctagctacatcatagtactcattaaccccatattaaaattacaccaaacttattttagctttcttttttactttttatattactatgatacaatatttttaataggattttattgtttgttaacttttttcactaaaaggagaaaatcatgcgttatgattttggaaaggtctataaagaaatacgtgagtcaaaaggattaacccaagaagaggtctgcggagatgtcctatcaagaaccagcctatcaaagattgaaagtggtaaggcaactcctaaatatgaaaatatggattttcttcttcggcaaatgaatatgagttttgaagaatttgactacatctgccatctctatcagccgagccaacggacagaaatcatgcaaacttatctcaatatgaattccatcattggtggcagtggtctagttcatttttttgaaacatgccaaaactatctcaagacccatcacgacctgcctatagaagaaatcagggatatgctggaagttgtcattcatattcgccaacatggtacagagcaactgtcagaccaagtgaaacagactatcaaaaaactttgggaaaaaattgaaaaacaagatacatggtatgaaagcgacctaaaaatcctcaataccatccttttcaactttcccattgaacacctccatctcatcactgaaaaaatcttgcaacgcttagaagactataaaaactatcaacatttatatgacttgcgaatgacaatcctactcaacatttccaccatttacttataccatcaagacaaaaacatgtgtcaacaaatctgctatactttactagaggatgccaagaataagaaaagctacgatatgcttgctatctgctatgtccgtattgggatttgtagggatgatgccaaacttatccaaaaaggattctcccttctagagctgaccgatgaaacttccattctagcctttctcaaaaaagaagtggagatctattatcaaccgaaagaaatataaaaagtcgagggatttcctcgactttttcaaattattctgttcgttatttcttaataccagccgttgttaagccagaagtttttagcagctgaccatgaaccgtaacgtcctgcaacgtaagcatctgctacacgttcttggttttcagctgagtagtcaccgttcaagtatgaatctgtcaattggtaacgtccaatgtattggccgtttgtagctgtatagctaccacctgattctttttgtgcaatccattctttagcttctgcttcagatccacttacagttgcagctggtgctgaagtttctgctgcagcaacagtttcttctgctacaggagcgcttgcagctggtgctgcttcttctactacttctgtagtttctgctactggagctgaaacagtttcatcttgagctgctggtgccgcataagtagctggcgctggtgttgcagcaggcgctacagggccatcgataaccaactcttgaccaacataaatcaaatgaacgttgtcgatgtggttgttttctgccaatttctcaacagttgtgttgtgagtttcagcgatttctgaaagtgtatcaccttctttaacagtgtaagttgatgattcttgagcagatacaaatgatggagcaaatactgcaaacaaggcagctactcctgcaagagttgttttaatctttttagttgttgatttcatatttgaaaattctccttctttctatagttctatcataccctttaaatattaccgtttcttgacacttttatgtagaaatattacaaaattattttttatttctctaaataagccattttttgttacaaaagatgcttttttatgctatttgtagtgtaaaaaggttttcatccacaattaaagccaagaccttcattctttgatataatagagataagaatttttataaggggaaactgatgaaatcacttcgttttcaatctgtctttgatatcatcggaccagttatgattggcccatctagtagccatacagctggtgctgttcgtattgggaagattgtctcttccatttttgatgatactccgacagaagtcgaattccaactatttaactcatttgccaagacctatcgtggtcacggaacagacctagcccttgttgcaggtattttgggcatggatacagatgatcctgaaatcccaaacagcctggaaattgcccacaagcgtggcatcaagattgtctggaccattcagaaagacagcaatgcccctcacccaaacaccactaaaattaccgtcaaaaatgctcataagaccattagcgtgactggtatttctatcgggggaggaaatattcaggtaactgaactcaatggctttgccgtctctctcaatatgaatacaccgactatcatcattgttcatcaagatattccaggtatgattgccctcgtaacagaggccctttcccgctatggtatcaatatcgctcagatgaatgttactcgtgaaaaagctggtgaaaaagctattatgattatcgaagttgacagtcgcaactgtgatgaggccatcgaagaaattcgaaaaatccctcatctccacaatgtcaatttctttaaataggaggaagcatgttttattctatcaaagaattggtcgagcaagcagatctggactttcaaggaaatgtcgcagaactcatgattacaacagagtttgaattgaccggtcgcgaacgtgaagaagtcttccttctcatggaacgcaatctagaagtcatgaaagcctctgtccaacttggcctcaatgaaaataaatctcgtagtggcctgacaggtggagatgctgccaaattggatcactacatcaaaaacggaaaaactctgtcagattacacgattctctctgctgcccgaaatgccattgcagtcaatgaacacaatgccaaaatgggcttggtttgtgccactccgaccgcaggaagtgctggctgtctgccttccgttctaacagctgctattgaaaaattagacctcagccacgagcaacagctggatttcctctttgctgccggtgcctttggactagtcatcgcaaacaatgcctctatctcaggtgctgaaggtggctgtcaggccgaggttggttcggcctctgctatgagtgctgcagccttgactctagctgccggtggaacaccttatcaggccagtcaagccattgcctttgtcattaaaaatatgctaggcctcatctgtgaccctgttgccggcttggtcgaagttccctgtgtcaaacgcaatgccatgggagctagctttgccttcatcgcagcagacatggccctggcaggtatcgaatctaaaatccctgtggatgaagttatcgatgccatgtaccaagtaggagcaagcatgccaactgcctttcgtgaaacagctgaaggtggactcgctgccacccctactggtcgtcgcctccaaaaagaaattttcggagaataagcttatcaaataggagaaaccatgacctctatctcagctatctttttcgatctggacggaaccctcgttgatagttctatcgggattcacaatgcctttacccatacctttaaggagctgggggtacctagccctgatgccaaaactattcgtggttttatgggaccgcctcttgaaagtagttttgcgacctgccttcccaaagaacaaatttctgaagccgtgcagatataccgttcgtactataaggagaaaggcatccatgaagctcagctcttccctcatattgtaggcttgcttgagaagttatcgagcaattaccctctttatatcaccactacaaagaatactccaaccgctcaagacatgactaaaaacttgggaatctatcatttctttgatggcatttatggttccagccccgaagcaccccataaggcagatgtcatacgccaagccttgcagacacatcaactagcaccggaacaagccatcatcatcggagataccaagtttgatatgcttggagctcaagaaacaggcattcagaaattggccgtcacttggggatttggagagcaagcagatctactaaactatcagcctgattatatcgcccacaaacccatagaagttttgaggtattttcaataacatatacatacgacaaggcgacgttaacgtggtttgaaaagattttcgaagagtataagtctctacataacaaaacgcatattaccaaggtttttctattcctgataatatgcgttttttgattgtaaatattttttattcaacgtgggtagtttgattggcaaaggcgataatagcttgcttcaactcatctccactaagagtgcggaactcttcaattttttgatcgattgcttctagaggcatgacattaactttaccaacgaaaatcttatccataacttgattatcaacaagttcggttgataccaagagttcttcgtagagtttttcgcctgggcggattccaacttcaacaattggaatttcgctttcggtgtgtccacttagaaggaccattttcttggccaagtcataaatcttgactggtttgcccatatcaaggataaagacttctccatccttggcataagcaccagcatggataaccaaacggctagcttctggaatagtcataaagtaacgggtcatgcggaagtctgtcaccgttacaggcccaccttcagcaatctggcgttcaaagactggaatgacactaccacggctaccaagtacattcccaaaacgaactgcacagtaggttgattggctacgttggttgaaaccagtgacaatcaactcagccactcgcttggttgctcccataacatttggtggattaaccgccttatctgtcgaaatcataaccatcttaggtactttggcttcatcaacagccttagcaacgttgtaggttccacggatattgtttttgaaggcttcttttggattgcgctccatcataggaacgtgcttgtgggctgccgcatgataaacaatagctggcttgtacttttcaaagacttgcaagagacgatcatagtcttgaatgtccgcaatcacaggaacataatcaatcccttggaacttacgaatcaattcatgataaacaaggtaaattgagttttccccatgaccgagcaagacgatgcgttcaggattgaagcgactaacttggcgacagatttcagaacctattgagccaccagcacctgtaaccaagatggtcttacctgtcagttctgcgcccagacgcgattcgtcaagacgaatttcctgacgacccaaaaggtccgtaatatcaattttttggaagccagtacctgcttggtgaagtccctgaacaacggtttcaaccttaggcatcttgtaacatttgacacccagcttattacacatctgcaagatacgttcatattctgacgggtcaagcgacggaatcgcaacgataacacgctcgatttgatggcgtttggctaattcaggcagatcatcatatgaacccaaaacaggaattccaccaagtttttggccctttttcttagaatccttatccaaaataccgacaagttctaattcactagttggatgttggtaactatccataaagagagctccaccatcaccggcaccaatcaagaaagtccgacggtgttctccatcaccacttccctttttgcgtttagagtagattaactgccaagtaatccgtggcaataaaattaagaaagtactcaacaagataaagagcacgataaaacggatggagaagagaggcaagaaggcatagcagatactatatgacaagatactgctagcagtcacaccaaaaaagattttcatgaaatccgtaatcttactgtaacgactgatactagcgttcaatccccaaaatccaatcatcaattgatagaacaggaaggccaaactcgtgtagatgatgtagtcaacaggtgctggattaatcaatccgtagaataagatataagatacaatgatggaaaccaccatactcaaaatatcaaatattccccagaaaacctgtttttgttgtttatttaaaatttccaccagatcaatcacataatctgtgagttttttattcatagaaatttactcctccttaaaagagctggatgattatactcaatgaaaatcaaagagcaaactaggaaactagccgcaggctgtacttgagtacggcaaggcgacgttgacgcggtttgaatttgattttcgaagagcattatattgttattataacactttttctaaagtttatgatttgctacaatcttttacttgctttttcgtaacagtttcataaaaataaactgtcggacaaatccgggacaaagggcaaccaccatctgaatggcaacactcttggcatactccatgtaagaaatttgtcctcgcttcagcatgcgttgacgagcttgacgatagagtttgaggtaacgcagtcccccacgacgctcaaacattcctgctccaacacgaaccttacacaagatttgatccagatttccagtcttagctcctgcagcaatcatattgagccagaggaggtcatcctccatataaagcccatcctcatagttgcctgccttgagaaccatgtccttcttgaacatgacagtcatgtggttaaaggcacttctcatcctttgataagctacaatatctgcatgctgggttggaacacgacggtaagaaacaatctcatcaggattgtcaataaactctgcaatatgtccacctaataggtcgaggttttccttctccattagctgaacctgtttctcaaaacggtctggaacagctatatcatccgtatccatacgagcgatgatatcgtactgacactgcaaaacaccctgtcgaagagccagacccaaaccttgattatgctcaagaggatagcgtttcactggaatatcagactcagcttcaagctggtctaatacctgatagagctcaggtgtcaaaggcccatcctcaaccagaaccaattcgctcggtttcagggtctgattttgaacactctcaatagcatcctttaaaaatgtcggattttccttgatatagaccgatatcaatacgctgattttttgcttttcagacacagtttttctccaatgtatagatttccttccactattttatcataattttcaagactttcccatttttatcttgaaagcccaaaaccttacttgacattataaggaaaaaaccttaaaataagctgttattaaaatcagctagaagaggtagtatatgaaaaagcaatcactcttttttgttccaggtattatactaattggtgtttccttgcggactccttttactgttttacccattattttgggagatatttcgcaaggactgggagtagaagttagttcgcttggtgtcttgaccagccttcctctcctcatgtttaccctcttctcgctattttctacccgactggctcaaaaaatcggcttggagcatctcttcacctacagccttttcttcttgaccataggttctctcattcgactaatcaatctgcccctgctctatctaggaaccttgatggttggggcaagtatcgcagtcatcaatgtgctgcttcctagtcttatccaagccaatcaaccaaagaaaattggttttctgactaccttatatgtaacctctatgggggttgcgacggctctggcctcctatctggctgtgcctattacacaagccagttcttggaaaggacttatcatcctcctcaccctgctctgccttgcaacttttttggtctggctacctaatcaccgctataatcacagactggctccacaaaccaaacaaaaaagcaaagcaaaggtcatgcgtaataaacaggtctgggcagttattgtctttgcaggttttcaatccttgctcttttacaccgctatgacctggctacctaccatggccatccatgcaggcctatccagtcacgaagctggcttgctgacttctatcttctctctgattagcattcctttttcaatgaccatcccaagcctgacaaccagcttgtctactcgcaaccgtcagctcatgctcgctctggtttcactagctggtgtggtcggcatttccatgctcttcttcccaatcaataatttcttttactggcttgccatccatctcctcatcggaaccgcaaccagcgccctcttcccctatctcatggtcaacttttcactcaagacaagcgcccctgaaaagactgcccaattgtctggtttatctcaaacaggaggctatatcctagcagcctttgggccaaccctctttggttacagttttgaccttttccactcttgggtgccagctgtagctgccctcttactcgtcgatatcctgatgactgtggccctctttacagtggacagagctgataaaatcctttaaacttctagttttggctagaagttttttatatataaaaattttacacatttctcttgacagggctttcatttagatgtacaatgtatgtgtagaaaaattatatataaaaatcttacacattagaaaaggaggtttcccatgtactttccaacatcctctgccttgattgaatttctcatcttggccgtactggagcaggatgattcttatggttatgagattagccagaccattaagcttatcgctaacatcaaagaatctacgctctatcccattctcaaaaaattggaaggcaatagctttctgacaacctattctagagagttccaaggtcgcatgcgcaaatactactccttgacaaatggtggtatagaacagctcgtgaccctgaaagatgaatgggcactctatacagacaccattaatggcatcatagaagggagtatccgccatgacaagaactgaatacctgactcagctagaactctatctcaaaaaactgcctcaggctgaccaaattgaagccatggactatttcagggaactctttgacgatgctggagtcgaaggagaagaagaactcatcgctagcttaggaactcctaaggaagcagctcacgaagttctctccaatcttctcgataaaaaaatcaatgaagcacccgatcaaaagaataaccgacaaattttgcatatcgccttgttagctctccttgcagcccccatcggtattcctctgggaatcgccatcctcgtgtccctgttcgcaatctttgtggcagccttgactgtcattctggctttctttgcagtttccatacttggtatcatcggcggattcctatttttagttgaaagtttcactgtcttagcccaagctaaatcagcctttatcttgatttttggtgctggtttactggctatcggtgcttcttcgctagtcttactaggtatttcctatgtagcccgcttcttcggcctactcattgttcgcctggtgcaatttgttctcaaaaaaggaaagagaggtgaccagcatgcgtaaatggacaaaaggatttctcatttttggtgtagtgactaccgttatcggatttatcctgctctttgtaggcatccaatctgacgggatcaagagcctacttgccatgtccaaggaacctgtctatgatagtcggatggaagagctgacctttggtaaggaagtcgaaaacctagagatcactctccaccaacacgcgctgaccatcacagactctttggatgatcaaatccacatttcttatcatccatcactctctgctcaccatgatcttgttacgaatcaaaacgataaaacgctgagcctcactgataagaaactgtctgaaactccatttctctcttctggaattggcgggattctccatatcgcaagtagctactctcgtcgttttgaagaagttattctacaagttccaaaaggaagaactctaaaaggaatcaacgtgtcagccaatcgtggacaaaccaccatcataaatgctagccttgaaaatgcaactctcaatacaaatggttatctcctccgaattgaaggaagtcgtatcaaaaacagtaaactcacaacccctaatatcgtcaatatctttgatacagaccttacagatagtcagctagagtcaacagagaagcacttccacgctgaaaatatccaagtacacggtaaggtggaattggtggcgaaaacagacctacaactgctactttccgaagaagaaaaacaaagaatcaacttagatctttcaacaaaacatggttctattcttcattttttaagagaaggaaggcgttcgtttaacaacgaagaaaacaaagctgaacgattaagcaatccttataaaacagaaaaagcagatgcaaaagatcaactcatcgcaagggcagaacaggatatctatctactcaaatcagaggaacacgagtcttcttctagaaatcgttgacaaaagcgcttacatctgctactatggaagcatatttatctaactaaaaaggaggttctaccatgaaacaagaatggtttgaaagtaatgattttgtaaaaacaacaagcaagaacaaacctgaagagcaagatcaagaggttgcagacaagactgaagaaacgatagccgacctcgatacaccaattgaaaaaaatactcaagtagaggaggaagtctctcaagctgaagtcaaactggaaagccagcaaaaagagacaattgaaacgcctgaagacagtgaagcaagaacagaaatagaagaaaagaaagcattagattctactgaagaagagcaagatctttctaaagaaacagaaaaagtcactatagctgaagagagtcaagaagcacttcctcagcaaaaaccaaccacgaaagagccccttcttatcagtcaatccttagaaagtccctatatccccgaccaagctccaaaatctacggatagatggaaagagcaagcgcttgatttttggtcttggctagtggaagtaatcaaatctcctacaagcagtcttgaaacaagtagcacacacagttacacagcctttcttttgctcattctgttttctgcatcttcctttttctttagtatctaccacatcaaacatgcttactatggacatatagcaactatgcataatcacttccctgaacaatttgcttcattaaatctcttttcgattatctctatcctagtagcaacaacactcttcttcttttcattcctcttgggtagtttcgtcgtgagacgatttatccaccaggaaaaagactggacgctagaaaaggttctccaacaatatagtcaactcttggcaattccaatcttcctcactgccattgctagtttctttgccttctttgacagcctacgatttacagccctcttgtgtgtgattagcattggaatcattctgcttgccagtctccatatcattacaagaccaagtcaatcaagtgaaaccgactccttctatcaattattcttgtctgtccttgtgaacggagttattatcctcctcttctttgtagctgaagtggcactgattggggattatcttcgtatcttgacctttctttaaacttcatactcttcgaaaatctcttcaaaccacgtcagcttcgccttaccgtatgtatggttactgacttcgtcagtttcatctacaacctcaaaacagtgttttgagcagcctgcggctagcttcctagtttgctctttgattttcattgagtagcaatcctgtctttcatggcaggattttttctatgtcaaaaaagcaagtcgattgacctgcttctactttacttttcttgtgctaatgttttaaaatcttgtcctaggatgggttgcacttctaattgattggcatctagttggtggtaagatgctgatggtagtgactctaggaattttgcatagttcaagcgggcaatggcttcatagtcttctggtttagagccgtctcctgtaatttgaaccaagtcaatctcccactgaacttccttatccagcaattgctcaatataggaagcaggaacaaatggttctatcggcaaaacagtcttgacgccttgagccagatggtaaacgccatgcacttttccttctccatcctgatagaaggaaactcttgcaaagtaggcatccgtctcttgaaccgcacgcacacgcgcttcaaactgtaccaagccgtcttcctctaaaaagcttttcaaatcctcatggctaaagaaaacaggataaaaaattcctgggcaaatcgtaaaacgagctgcagtgtctgctagatgggcttgaatacttgcttggaaataagcttcaaaatcaaaaccatctagtccttcaatctcagttcctgtataagcaagtagggcttctaaaaatgctttgataatctgccagtctgtcttcgttagtaggtcaggaagatcaatacggtaagccttgtgatcatcagcatagctaactttaaagagaaattgtgattgtcccactatcgcacactcgatatactcaagacggctaagaggttgacggagatagactgcatcatagctatgtgactccaaaccatctagcaaggccaagatcgacttggcagtcaaaatctcttgttctcctaaaatgctctgtttatttggaataaaaaatgttttcgtcataactggactcctttgaaatcgtttacatatagtataccctattttcctgaaagatacagaaacaaactttagattttttagtaaaaagcatagaaaaacagcccctaaggactgttcaatcttatacagtagctgcttgatccaagctttcaccgatagcggctaggcgctcgacaacttcagcttgtgtcaattcattttctgaaacatagcggttacgtgggtgaacacggcactcgtgtgagcatccacgaaggtacttgtcttcattttcttctgatgtcaagatacgacggttacagaatggatttccacagtttacataacgttcacatggtgttccatcaaaccagtctttccctacgatggttgggttgacatggttgacatcgactgcgatacgctcgtcaaagacgtacattttcccatcccaaagctcaccttggacttctgggtctttaccgtaagttgcgattcctccgtgcaattggccgacatctttgtagccttcacggaccatccagcctgagaatttctcacagcgaaccccacctgtacagtaaaccacgacacgcttgtccatgaatttttccttgttatcacggacccattgtggcaactcacggaagttgcggatatctgggcgaatagccccacggaagtgtcctaggtcgtactcataatcgttacgtgtgtcaaggacaactgtatcttcgtcaagaagggcttctttgaactcttttggagacaagtaggcacctgttgtttcaagtgggttgatgtcgttgtcaaagtcgttgtcttccaaaccaaggtggacaatttcttttttgtagcgaacgaacatcttcttgaaggcttgttcactttcttcgtcaatcttaaaccagaggtcttccatgcctgggaggctgtgaacgtagtccatgtatttttgagttgtttcgtagtcacctgaaactgttccgttaattccctcgtcagcgactaggatacggcctttaaggccgattgatttacagaaagccaagtgatctgcagcaaattgctctgcattttcaattggagtataaaggtagtaaagtaagacacgaatatcttttgccataagatttgttctcttttctattcttaaattttcagaatttttcatctaactatactagtatacctgcttgagaaaacgaatgcaatttatttgactggaaattgtagaaaggtgcttatccctgcacttcatcagtaaccatagcgaatagcagataattctctcaattttttgatctgctcggattgactttctgataacatcagcttattgtcaatcaacacacgtgagatgtcaacattcatttgactcaaaataaatggagtagaggtcccatcgtcctctaatcgtcttttataactcactaacagatttttcaaaggagcaagttgaggcgtattgcttataccttccagtaggtgatctatgatagtcatcgcttcacaacgtctttcgcttcctccagcaaaccattttaatggtgtcattctcattttcctccttaaattgaaaagctatcattcctaactctcgtaccaatatttcacccaaataccctgtgtaaaaaagtcagcaaaaatggtaatgttgcgaaaatattattaatcacatgcaccgcataggatggataaatgctcttggtatagcgggtcaaactagcaaagatgatgccagatgttgcaaagacgaagatatctaacagactaggcagactcaaaaaatgaggaagagcaaacaaaatggaaggaagaagcaaatcaaggccaaatcgcgaatgcttaaagaaggcgtgttgaagtaatcccctataaatcaactcttccataagtggagtcagaaagaacaaagttatatagatacctagctcagcaaagttggtcccactataaccgatcaatacggcccaaccttcagcagttgactgaacatgtttagctgtctgaacgttaaaagagatctggagcactaccactaatactgtcaaaatcgaataccaaagccatttttttcttggaatgtgaaagagataaccatgacctgtcttaaccagaatccaaatcatgactccgctaaatagcaaactcaagagattttgaatccagacgaaattgccaatctgggaagaaaattgccaataattttgaacaataagcgtcagctgagaaagaccaaatacgaaaaataagtaagagaaaactgcacttattttgaagacaagctgatactttttcatgtgaaccctcctttgtaaacttggaacatctctaatataagccataatttcctaaatccttactccaaatcctaaatggtacttaagatttcctgaatggttaaatagtgataagaaaacacggatatctatgctttcgtttcaaaaaatcactgcctcccccagatagacctgaggaaaacagtgattcaatttttaggaattaggaatgaatacacgaaatcaattgatcttatgattttttgtttttcaagaattcatcgtattgtttttgcatttcgttcaatactttatcgtaagcaccttcagatttcaatttttccatcaattctggaatagctttgtctgggtctacagtaccagtgttgatagctgtatcgaattgttgcattgtgttagagattgctgaaatttcagatttcacattgtcagtgttaaagataaatccaagtgctggagattctttagcttcagccaattgtttcttagaatcttcgatttgttggtctgtaacgttttcgttgatgtaaaggatccagttgttaccagtgttccatccacccatgtgagtgtttcctttgtagccatcaaggactttaacacggttttctttacctggaattttttcccagttcttgccttctggaccataaacaagaccattcaagagttctgggttagtgttcaagaggttcaacacttccattgatttttctttgttcttagagttgtttgagatgacaaagttagcaacttgtgttgtttggtttttcttgatgaagttagtgattggtttgatttggatatctttgttcgcaacacgtgaaagcaagctgttaccgtagtcagctggtcctactgtttcttcacgaacgaaccaagtatcttgttgaaggtcaaatgaagtatcgcttgttgctacgtcttttggaatgtatccagcttcatagaatttgtgaagagtcttcaagtgttctttaaagcgaggcacttcgtaacggtttacgatcttagtagtgtccccttcaaggtcgataacgaatggaagtccgtttggaactgggtagtcaaagttatcagatgggatgaagttcttagtaaccgcaaatggcactacatctggagctttttctttgatttgtttcaagactggttcaagtgtttcatatgaagtgacacctgaaatatcgataccgtatttagcaagaagagttccgttgaaagcgaagttttgagatgatgcaacgttggctgcaactggaactgcgtaaattttaccgttaatgctgttacctttgatgtaagctgggtcaagtgctttataaagctctgccccttctttcttatacaagtcagtcaagtcagcataggcacctttttgagcatttacaacatagttagatgcaaaggcgatatcgtagttttcaccagatgatgtgataactgacattttcttatcatagtcaccccatccaagatattggatatccaatttagcaccaactttttcaccgatgattttgttagcattttctagcaattcatctaagttatctggtttgtcaccgatttggtacattttgataacagttttttcacctgaagctgagtcagcagcttttttactgttacctgaaaggtttccacaagcagcgagaccagcagccaaagcgactacgctagcagatgcaaaagcatattttttccagtttttcatgacaaaaactcctttttttatttttaaacttataaacaatgtaatgatcttaacttcacgcaagggaagtttggaaatgagaaatgatttttctcgacaagtactattctttcacaccaccgatagtcaaaccttttacaaagtagcgttggaagaatggatacaaaatcgcgattggaagggttgcgaccacaaccatggccatacgacctgtttcttttggaagagcaactcccagttgaccagataggccgactgctttggcgatgtaatccatattttgttggatttgcatgagcaaatattgcaatggatacaagttgtcactcttgatgtaaagaagggcattgaaccagtcattccagaaaccaagagctgtcaagagcgtgatggttgcaatacctggtagtgacaatggcaaacagatttggaagaagatccgggcctcactagcaccatcaatacgagcggattctagaatagcttctggaatggtcttcttgaagaaggaacgcatcaagatgatgttaaatggtgagagaagcattggaacaatcaaagcccaaactgtatcaccaagttgaagtaaacgagttaccacgatatagcccggtaccaaaccagcattgaacaacatactaagaagggcaaagattgtaaagaatctgcgatacttaaaggttgtccgtgagatagcgtaggcataggttgttgtgataaaaacgtttgtgatcgtccccaccactgttacaaagactgagatgaagagggcttggagaattttatccttaaactgtgccaaaaactcaaaaccgtctaatccaaattgggatgggaagaagctatatccattttggaggatactcttttcatctgtcaccgaaataacgataacgaatacaaagggtaggatacaagagagggcaaccaaaccagaaatggtactgaagaagatatctgctttcttactgaaggagtgaatgccgacattatcaattttttcttttttaattttcttttctgccatattctcctcctttctagaacaaggctgagtttggatcaactcgtcttgcaagtaagtttgataggataaccagaatcaagccgacaactgattgataaagacctgccgctgatgccatcccgatatctgctgtctgagtcaagccattatatacatatacgtccaagacattggttacgttatagagctgaccagcattgtgggggatttggtagaaaagaccgaagtctgcacgaaagatatttccgactgcaaggatggtcaatacagttaccaatggtgtcaactgcggaatggttacattgcgaattcgttgccatttgctggctccgtccactgtcgctgcttcgtagtaggttggatcaattcccatgattgtcgcatagtacatgacactgctatatccaaaacctttccaaatacctaggaaaagtaggagatatggccagatgcccaagtcagcgtagaaattgatttccttcatcccaatagattctaggaaatggttgaatacccctttatcaatgtttaggaaggcatctgtaaagaaactgatgataacccaagacaagaagtaagggaacaacatagaagtttggaaaatcttaaccattctcttagaacggagttcactgaggatgatggcaatccctactgatacaatcaagccaatgaagataaagccgagattgtagaggacagtatttcgtgtgataataaaggcgtcttttgaactaaacaagaatctgaaattatcgagtccgacccatttactattcacgatactatctataaaaccattactggtcatgtggtagtctttaaaggcaaccacgttcccaaatactggaatgtagaagaatagaatcaaccagagtgcccctggtaaaaccatcaagagaaagatccagttgtctctcaaggtttttgaaaacttattcataatttcctcccttttttattttgatatccatctaaaaattcctttttagatttttgataacgattacattattagtatactcctatttgaaggttaggttaaactactaattatagaaaaaactccacaaattattttatgtggagtacttttttaagaaagggatgtttcacgagaaacactctgcccaaggcacggtgttcttgtttcttatgtcgtgtagatggttgaagctgtcgcaatggtatgccactggttggctgttgtggctgcgaagtccttgtctgcgtaaaagtcagtaaatggcagaatttccacttctagctcatcgatacggtccagctgacctgccagataagcctcgatgcggctttctgctcgtttaatgcgttgcaagagtcctcccatacggatgtcaactgtatccaagccaaagaccttgttttccttcaaccattgatggctaaagagggcatggaagtcttcaattcggcttctgagttctggtaattcttgtctggcaatttcttgcagactttctttatcgtttgtttggtaggcctgacggatgcgtcttcccacatccactttgctacttaaaatggaattcaactgggcctgagtttcaaagagataggaatagttcccagctttttctttaatgttagcgagcatctcagcagcctgagcgaagtgcagtttgtcctgttcaggtgtcatgtgctggtcaaggatcggacagagaacatcctgataaaagacatagcggttgggattgatgccactgagattgcctggtagatctggcaagaggttagcaaggtcaatctgcatgaaatcctcaactgataggcctgtattggtctggaaatgagcagacaaacggtctaggtcattgcggtagcagagttctgcccagatttgcaagcttgggagaatagaaaactgggcagtttcaccaccattatccccccaaccagttacgatgacttctttgatatcattagcacgacaggctttattggcttcaagagcgatgagacggctgaaatggttattgggtgtgaaaccaatccacttccaagctccccctgcaaaggcgatatcttggctaatcttgtggtgattacggaagttgcgattgtatttttcctcactatcctgataatagtcccagtaaaccaaggtcacacgatctttgagacggtctaggtagacacgcgtttcctctggaatttccacatcacggtcgtactggccatctgttgacataagtttaaagaacatatcgctccacatctggcagtggaaaccatatttgtcagcaatatccagcacgcgctccaagtgttggcacatgaggagactacgatccacaacaccgttcagaatcaagtagcgtcccaaaccaaccaagtgggcttcgtccatcccgatattgaccttgcgagtttgtagtttagacagagtagcaaacataccatcaatcaggtcataaaccttttcttcgccgataagaaggatatcctctacatcacggagctcctggacttctttaacaccccatttgacaaaggctgacaagtgggccaaagtctggatacatggcacaaaagtcatatcaaactgctgggcataggcttcgatttcctgtaactccttagcagaataagccccgcggaaatagccaaagtaaggttgtccttcaatctggtaggtgtcttccatgtaaagctcaaaggttgagtagcccatgagagccaagacctcaatcatctgcttggcagcagccacattcagcaccgcatttctcgaacagtctgccatgtaggctaaatcttcataagccgcctgttcctcaatctctactttatcaccttctgctagagctgttaccaacaaggacaaggcacgataaagttggtgaggtttactgtaggtcaattgatagtgaccatcctcacccttgatagagatagaggcttggtcagactgagcgacagctacctctacatctggtagcgaaatgtgctttttaagcaactctactgcttgctcttgttttggactaagtcctgtaaatcttaccattggttttcctcctgtagccagttgacaagggctccgtagagattagcatctgcatgataggtgcaggcttggataactggtgcgaccgtgtattcttcgtaggtctcgacaaagttatcaacagccttcttgacaccttggatgaaatctgtgttttggctgatagagccacccagactaatgacatctgggtcaataagatactgaatattaagcaagccttgcgccagattacggttcattcgctcaatagcttcttgacaaagggtatttccttctgcggcctcttggtaaatcttgcgaccgtcccagtcagtctgaccagatttttcaatcacgtagcgtaccatatttccagttgacgctaattgcgaccagttgttgagcttttcagcaggggcaagggttgtcatgtagccaaattccccacccaggccgtggcgacctcgatgaagtctaccattgataatcatggctccgccaatccctgtcccaatcacgacacaggctgcattttcaagctctggatgagctagtagttcactgagtccaacgcagttggcatcattttctagatggacaggaatctgataagagctaagcgcctcataccaagaaaatccgtgaatgtagggcaccgcactgaagccatcaatcacacctgtctcttgattgaccgcgcctggaacgctcatagcaatcccactgtaatcctgctctgacaagcgctgatctagccaagctagtaagtcctccaagttttctggtgttgggatacttgtcttatatagtattttcccatcaggagtcagactggcaaacttaattccagttcctccgatatcaatcgttgcaatggtcattgtttttaccataaaaaggggcgaatcagcagttagttcttaccttttcgcccctcctttctttttatgtttactttttgaaattaaatttcttcttttttgatgaattctgtacgaatctcttgtggtgaaatgaggcctctatgaactggatatggtcgttcaagtaggtcaaggaagagatgttgactttccggtacacgtacattttcactacacatattatagtaacgaagaacatagccttcttcattttcagctaccttaaaggctgttggacagatttgcggtatgctgataacagaatggctcaataggctaccagtcgcagccacgcttccttcttgtttagcaagctgaaggctagtaaatggtgtctgcaaggccttagcacgacggaaagctgagaagcgttcttggacttggtggcattcaagcgcaaactcgacttcaaactcacgcaagcattgtgcttctggtgttgggaagtaaccccagtcacctagctcacctgatgcacgcaaaatagtcactgcaatggtgtcgtctccaaggatttcgtattcattcaatcccttgttggatacagtcacccctttttcatcgtcatacagactgacaaaggcttgttggtgttgaggattttcaggattttcccatgaagcagctggtttgtttggtcgtgttaccacctcatagatgctttcagaatcattgcttggacgcgtgttatgagtcttgaccaagagacggatacggtggtctttggcagtgttagtaaagcgagtcttgcaacggatttgtggattatcaacgaagatagtcatctcagtttcaagaggaatgcttgtcaattcttctgaacgtccagcttcacgcttcataaactcgatgatgcctttttgctcttcttctagcttttcatctgcactgacaggcacggtcaattcatgtttgagcaaaatcttagcgtagcgagctgtgttttccaagacctcgtagcccttaagctctgcatagattggctctgttccttttggttggaaatagatatactcgtttccgatgtcaccacggtcttcgaagcggataaaatcttcataggcttcgtgagttgtcttgtcatagactgtgatattgtcatccacacttaccgttacaaatggcgtatcaatcactccgttttggtaaataccgtcgcggtgttcttgctctccttccagcaattggaatgttgtccaagaaagtggcgctaggtgaactgggatgatcacgcgcacttgtcgagcaatacgagcttggcggaacttatcttttggtaaatcgtactcaaaattagctccgagatcttcgattttagcctctacaggacgcccatccaagtcctccacacggtaacttggcaaggtaagagcagccatcttcttgtatccttctgttggatgcaactccttgaaatcacaagtcgctacatcaatcactgtgctgacagtatcaaccttatcatgcaagcctgtgttaatgacagtaaagagatagtcactttgagccttagctgtagctattttgcccttccactcgttaagaaggttagtcttgacaaagtttccgacttgattgaccttggcaaaacgtgtctccatctcacggtgaacttcgtccacgctacagccacagatactatcatgcggcgcattttgcaaaagagttttccatgcataagtcaactggtccttgtggttgtggcccccagtgataatagtcagtggttctacaatttgctctaggaggttgctattttcttggaaggcttgtttgagataaatacgagatgaagaagtgttggcaagtgtgtaccagccgtctgtttcctgactggtcaactcacctgtaaccgttgataattgctctggtagggcactttccacggcttggacatattcatcaaaagaactatgaacaaaggttacatctgggaagagttcatttgccacacgaatggcttcgctcagatttttctgtacaggctggtgatcacatccgttcatcatcaaccattggttggtcgaagcataatcacgcacatctgacaatttttgtttccagaaggtcaaggcctcatctttatcaactggaatttcattcccgttactgtaccagttggcaaagaggataccgaggacacgacttccgtccgcaccctgccagtacatttctgaaaactgggaagtaaactgctcatcttcgagaacttggttgtcaaatccaatcggcttcacaccacgaccaaaggctgccacgtgaatgcctgatttttgaagaatttgaggcgcttgtcccatatttccaaaggtatctgggaagtaaccaatctgagttgatttgccccattttgcagcctcctgctgaccgataagagtattacggacattggcttcacttgaaatcaagtagtcatcttgcaagatgtaaaaaggaccaattttaaatttgccttcgtcaatatatcgttggactttgtcgcgattctcagggcgaatctccaagtagtcatcaaggacaatggtttgaccatccaagtggaagctcttgaactcagggtcattttcaaagagatcgaagagattgtcaaataattccaccaactgcatacggtggctttcaaaaggcaagtaccactcacggtcccagtgactatgtgagataatatgtacaacaacattttccatgaagtaaaacctcattctaaatttaaatttttattgttaacgttttaaatgtaaatttgtgattcttttcaagaatcagttacgctaaagcgtgttccttagcggatatccaagtaatccaagaccaattcacagaacatcatgttggcccaagagaaccattcacgagaataaagagttgggtcatccacgtggaagctttcgtgcataacacctgtaccaccatcgcaagcaaccagctgatccagcaagaattttttctctgccttatctctcgttgtcaaaccttggatagaaagggcgattggccagatatagcgatagaaggtatgagaacttccgagtccactagcacattctccttggtagaaatatggattttcagggctcaaaatggtacgacgagttgcttgatagacttcgtcgtcaatatcgcagtagcccagataaggcgcagccaacaaacttggtacgtttggatcatccatgatgctggcatttcctagaccatccacttcaaaggcataaatcttttcgcccttgctgttgcttgtgtaggcgtagttttcgatgccttcttggatttcagactggaggcgcttagcgtctgtgataacactctggctatcagctagatttaatgctgcgaagatctcttgcacataacccaagactactacagcaaacatatttgacggaatcaagtaactatactgacagcagtcatcactcggacgaaaggctgaccaggtcattcctgtcactgcaaaatcaggtccaaagccatcatttaccagtgtatcttccttacggtccgtatcgcggacaaaacgataaggagagttattatggtcttgttctaccgtccagagatggaggatttccttagtcgctgcgacaaaagtctcatcaaactgactagtctcgccagtctctttccagaggagataagccaactgcaaaggatagcaaagcgagtccacctcgtacttgcgttcccaaatccagccattcaggtctgtgtggtcggtctcgtggtgtcccttccagttttcctcaatgttgaaggaattggcataaggatccttgagtaccaaggtcatctgacgtttgaccaaacctgcaatggtctgacgcaggagggcatcccttttagccacatgcaggtagggtctgagttgggctgtcgaatcccgaagccacatggcaggaatatccccagtcaagacaaaagttgaaccatcttctagaatttcaaccgtattgtccaaggtatctgtgtagcaacgctcgaaaacatccacccactctggatggtccttagcccgctctgctacttcatctagccactctctaacaatttcttttgaataaatcatcgtgcagtatcctctttcaaacaagtttcattttcagtatatagcttttgagacagaaaatacatacacaaatgatagtcatttttctacaaaatagttatctttgaaactccttttctataggttatatttttctgatataatgtagaaaaacagctaaaggaaagactatgaaaccactacttgaaaccatcgatacccgctttggaactgccagcaagcatgccttttctcggggaaataccctgccatacacaggcgtgcctttcgggatgaattactttgtaccccagaccagtgaccaggagggctcttggtttttcgatccgcatctgcctatctttcaggggattcgactaacccaccagcccagtccttggattggggactactcttggctccttctgacacctgtcacagggcagataggtggagacagcctcttctatcgtcagtcttcctatgatatggataaggcctctttccaacctcattatctgaaaattttctccctgcgctatcagattgaaagccagctcacaccgacttgctacggtacttctattcttttagagcaaaaacaaggcaaagccctctccctctaccttcacgcagcagatgaactgacagtagaacaagtagataagcgaactcttgccctgcgacaagaaggtaaaactgaaaccaacaaaaatccactaactatgttcactgccctgcaaatgaatacggatattcttgctatcatccaagaaggcgaagactggcgaattgacttagcagatagccatgctgagattcagctagcgacttctttcatctctccttctcaagcactgcttaatctacctcaagaagattttgataactgtaaagcaaatgcgcaagcggattgggaaaatctcctccatcgttttgacattatagagacaggagaagctgaccgaaccttctttgaccactgcctttacagactcttcctctttcctcagactttttatgaggttgatgaatcaggacaagccatccacatagatttggctactggaactgtcaagcctggtgtcctcttcagcaacaatggtttctgggataccttccgcaccaccttccccctctttgcccttatcataccggaacactaccaccgctttttagaaggtttcctcaatagctaccgcgatactggttttcttccaaaatggctggctccagatgaacggggtatgatgccaggtacacttttagacggtattatcgccgatagcgcctgcaaggacatggcccccgacctagaagaactcctccaagccatgcttgaaacagccagcaaggccgaccctctcggcatcaatggtcgtcacggactagcccaataccaagaactaggctacctctctaccgatcaccacgaaagtgtcagtcacacccttgactatgcctatagcgacttttgtatcgccagctgtgctgaaaaactagggaaaatagaaatcgctgaaacctacaaggccgcatcacaaaattaccgccatctatttgacgctgagacaggttacatgcgagcgcgtgatagtcaaggcaactttcgccctgacttctctccttatagttggggacgcgactatgccgaatgctctgccatccaagcaactttaggcgtcctccacgatatcccaggcttgatccagcttatgggtggaaaaggagcctttagcaactatcttttaaaagcctgtcaggaggctcccctctttgagacaacaggctatggctacgagattcacgaaatgagcgaaatggctactgctccttttgggcaactcgccatttctaaccaacctagcttccacattccttatctcttccgctacagcaactaccctgactacactgcccttcttatcaagaccttacgtcagaaagcctttcacccaagctggcaagcctatcctggcgatgaagacaatggtagtctctctgcctggtacatctggtcggctctcggattctatccaacctgtccaggcaagcccagctatgatctcggagtccctctctttgaccatctccgagtctatctcgctaaagaagataaatggctagatattcatactgagcaaaaccacagccacttcaactttgtcaaagaatgccgactggacacaactctagtatcaactattcaacatcaagacctcttaaaagctgaacaactaaccttcaccctcagctggttaccaagtcactagctagtagacaaaagaacctttgtatcgtgcaaaggctcttttattttatgaaacttgtacttgaagttgatccagaagctgaccacccaccgttaggttcagatagaaatccaaggttttatctcctgcaaaatacaaggttggaagcgtcaatcttttttcagtctcgccaacttgaaactcaataacttgaatctcgtcctgataggcgacaccatggacacctgtccctggttgaatcgaaatcttagcctctaaaggagtattactttcgctacgttcaatcctaaaatgaagagtctctccctttgtcacagctagacttttttctgcaaatgctagcccctgaacaacttctgtttttgataagctaggagttttatagagtgaaatctttgtcaatacaggtaaatcctgtgactctgtaatcatcacgcgcaccttctgtgcctctactagcgaacctcgcaagaggcgcttataaccaactgtaaagcctgtaccaaattcttgccagacaccgtccacctctacttgcacataaaaaccagcaattcgttgccctagcttcaaatcctctcttaactcaattacatcaaaagttttaggtgaccctaagtcgagttctaactggattggcaagcctgcatcgcttgcccaagagctggtcttaaggccatctgtcaaatagtgacaggcaaagtctgcggaaagagcagaaccagataccttagctcccagagccaaatcttctttatagagctcattgcgataggccgcaaattcatagaggcgttcaatatcctttgcatcaaatagcccagcttgattcggcggaatattaagtaggagcggggttcctctccccactgagtgaaaatagatttcgaccaactcctcaagagacttagaatcctggtcctcatggtaaaaccaacctggccggatggaaacatctgcctctccgattgaaaaaatcgtacctgagggatctccatgctgaagatagtccagctctgcttctgttcctagtttgtcagaattcaccttttgccacagtggatcacctgcataccctcgttcattgccaatccagcggatactggtgccttctgttgaaaaaatcaagcaatctccctgtagctcacgaatggtttcaaaccatttctcaaattcataattgaccttttgagcgccctctcctctagcaccatccatccatacctctgcaaatttcccttcatttccataggcaggatttgataaaatctcctttagctgagccagataataggcattatagtccgcttctcgctccacatgatagagaggactgtgggcatcccaaggcgataggtagacccccatatccatatcaaactccgtggcagcttgggatacttcaaggagcaaatctccctctccattcctccaaggactggccttgaccgaataatctgtgtgagctgtcggataaaggacaaaaccatcgtggtgcttgaccaccaaaatcaacttcttaaaacccgtttccttgagcacgcgaacccactcccgcgcatctaaccttgtcggattaaatcgttcaggatcctcctgacctgtcccccattcctggtcataaaaggtattgggcccaaaatggataaaggctgctagttcatcccctaaatacgctagctggtcctgactaggcaaggggccatgcggttttatttctcttaccatactacttcctatctacacttttcttcacttttttgtcatgcacttgcaattctgttaacgctagagggcttgccaagccttcaaatcgaagacgaagggcataggtctccaccttgtcaaattcaaaacgaagctcttcatccttgtcgcttgaaactttttggatagctgatacagggcgccaattctcctcttgcttgagcagagaatccttatccaaatgatttggagtccgaggcaaggcaggctcattccctacataataatcgatatgggtaggatccaccgccacgtattcttgattttcgacataatacaaggtcacgttatccacaaatcgcggttttaaaatccctgcatctccaaacagaataccgacgctagcttgctctgacttggcaatccaagtattggctgtcgatttcttccgagcaatgaccttatcattgaggtaagatgctgaatgattaggctctgagtgagaagcaaagaccagaggcagattggaccctgtccactgattggaaatgacttcaccatctacactggcatctgtcacatgaatggtgactgttgctggtaactcacagcccgctacttgtcctgtgagcacactttctcctacctgagcatagacttgaggttcaagttcatcccaagtcaccttggccgtatctcttctgccatctgataagactagcttgactcggtctggtaagtgtggggcttccttgacaagcgtccaaaccctttcaggctcaatagcgcaaatcccttgaacacaaacctgagcagaagcctttaaatccaaaccctctagctggccagataccgtaaactcatgaaagcttgccatatcttcttcggagattgcctcccaaacaaccttgactcgttttgcactaccagactcatagtccaccaaaactgaagatggcagctgtggataagttcccttagctgtatacaagcgaagtggtcgtacaaaaactgcctgccctagcgaggtattttctgcgacctgcaggtgcatttgataggtcttcccttgataaatggcgcggatagccaagtcacctgcagacaagcaatgaagcactccctgcttgataatggcgtgggcactaccactcgtctcccaaatcacttcactattccccaccttgttcacagggttatccacagtttgtggataaagtccaatggctggggaatctccttcttgcaagcctgcctgcttgtccactcgaatctcaaacaagcgttgatttttcactggctggcaagcaaaagcctctcccactaagaaattaaaacttgctggctctagccctctggcactggcctttactcttacttggcctgcctgctccaagctctgaactaagaggacacctctaccatgaaaggctttcctcttaaaccgaccatttttctgagcctggtaacgttcacgactagcctgccttccattatccactcctacaatacgagcagggccttcaatttcaaaatgaagctgattggaagccgtcggcacccaatttccatccttgtccaatacatcaaaatagagataaaggaggtcttgcccatctggctccagttttgttttctcagcatgtaacccgattttggctggcttacctgcagtcaccaccctatcttctgccacaatctgaccttgatggtcatagaccacagcacgcaattctcctggttgataatccaaacgccattcgagatagagttgatcagaaccttctccctcttggtattttctaccatctgaagtccatttttcctgaaaagtcttcctgccttgagattttccattgagaaatagttctactgaaccagcatttgaatacactcgaacagggatatccccatacttatccacaacttgttgataactcttgtggatttcccaattccagtgaggtaagatatgaaccatgggatgctgatctgcatccaaccactgactttgatagaaataatagtcatttttaggaatccccgccgtatccacgatcccaaaataggaactcttgacaggtgtgtcattttggttgtgccaaggagtcggctcaccgatatagtccactcctgtccagataaactgacccgcatagtctaaccgatttcgatctactatccaagcagccgtcgccgtcttcccccaaggaacccgatcattaccatagtctgactgttcaaaattccgcacgcggcgattatccccaatccattccttatctgggcgaaaatagctatcacgcgtccgtgtagccgatgaggtttcagacccgtaaagtcgccacttgggatgtcttttgcgaattccatcaatattatcttccgagtaattcaaacccaccacatccagcaaatcagcaatcttttcatgacctccagaaccatctccaaagcggaactggtccattcccatggtcacaaaacgactatcatccacttcctttaccctttctagcaagcgtttgatagtcttcaatgaatgagcatcgccatttgcttcgctgacttcatttcctaaggaccacataaaaatcgctggattattcttgccacgctcaatcatagtgcgcaaatcataatctgaccagaaatcacctgcttttgcttctggatgagttgcttcttcctcaaaaaagcgaccatagtcatactctttcttgcctccataccaagtatcaaaggcttcttcttgaatgagtaggcccattttggcagccacatctagcaagatgctactggctggattgtgtgttattcggatagcgttgactcccatttccttcatttggcgcaggcgtctctcggtagctgacctgttttccacagatcccagcgctccgtagtcatggtgtaaacaaaccccatgaatcttcaaccagcgaccattgagaaagaaacccttatccgcttgccaatccatataacgataaccaaaggtctcctcttcttcatcaaccaaaatgccatttttgtagaggtgagtcttcaattggtaaaggtaaggttgatcaatatcccaaagcaaaggttggaaaattgatattgcttgcttgaaatgatgtttttccccagactcaatcattacagagtctgtcacctgccagtctgaaacctgttgtccatcataccagatactctgctccaaatacaccgacacggactgaggtccatcatttgaaaccttacttgtaagctgggtttccacccaagattgcctttgttcctttagcttgggactttctatcttaatcccatataaatccagatgcaccgaatctgtaatcaataattttacttctcggtaaataccgctaccagagtaccaacgactgctaggttgctgattttccacaaaaaccgcaagctggttggccgtcccatcatttcttagataaggcgtgatatcataagaaaagggcgtatagccactgggataatagcccagcacttgcccgttgatatagacttgggcattcatgtaaactccatcaaacaacaaacgcaccgatacaagactggcatcttcttccaagtaaaactgtgtccgataccaggcctgacccccatttagctgaccaccctcattttgcgctggcgaatactggtcaaaatcattgtgaatactccagtcgtgtggcacttgaatagcctgccaattttccctctgaaaatccgacgccaaggcctcttccttccccacctcttggctaaaaaaccagtgatttcgtaaaacttcttctcttctcatacaagcattcctctttaaacgaatcgatatacttgactatagcacaaaacaaaagcgctttcaagacttcctccatcactccctaaatcctcagaaaagattctataatttgtggaggaggatttagttctcaaagatacaagggtaatacaaaaagagcctgactccaggctctttagtctattatttcttctcagcacggagggctgacaagatttgtgtacggatatcatccacaccatttggcgtatttggtaaaaagatagtttgatttcctttagaggcaaaggtattcaaggtatccaaatactggttggtcaagagtatggacatgatttgttcttctgtcatgccaacattggcttccttgagttcggtgatagactctgccaatccatccacaatcgccttacgctgttgggcaatccccacaccatgaaggcggtctttctctgcttcggcttcagctgcagtgacgattttaatcttgtcggcttcagccaattcttgcgctgcgacccgcttacgttgcgccgcattgatttcattcatggattgcttaacttctgcatctggttcgaccttggtaatcaaggttttcacgataatataaccgtaagtagtcatttcttccgccacttggtgttgaacttcgagggcaatctcatcttttttctcaaacaattcatccaaggttaatttgggaacagaagagcgaagagcatcttcgatataagatttaatctgagattctggacgcatgagtttatagtaagcatctgtcacgctctgctcgttgacacggtactgagtcgctacattcatcataacgaacacattgtccttggtcttagtctcaaccacaatatcgctttgcaacaagcgcaactgaatccgcgctgcaatcgagtcaatcccaaaaggcaagcggatgtgaataccgctattggcaaccttttggtatttcccaaagcgttcaataatcgccaccgactgttgacgaaccacataaactgtactcagtgtgactatcaccaataggagcacacaaaccaccacaaaaatcatcaaaaatgttgttaccatcgcgacgacctccatcattattttttcctgtattatagcacatttaaagaaggttgtgcagtttttactgcgatttttaaaaataaaatgttaaccatctattttgtaactaaaaaggatagcctcatacaaagctatcctttgattctcatcaatgcgccaacatttcttgggcgatttcttgtccagatagattatctgggtagtaggttggccagttatccatttcttcaaagagagcttcttggcttgtgcctccaaagaagatatggaaatgttctgccttaactggggcgatattgtggtcactaaactgaacatacttgaactgtccagcatcagcatctgtggcttcaaagaggaagcgcacgccacgattacctttcttgtaagttaagattttcttaccaacatacttgtaggtgaatttcttactttgtccaccttgaacaaattccatagtgttatcagtgatattaatcttagtcacatctgtctgatagccctttgtatagtaagccttgtactcagcctgagtcatcttaccagtcaacttagccttgtagtcaaagacttgatcaaacgtgccatcttcaaggaaaggataaactgattgccaattacctgcatagtcactcaaggtgcggtccttgacagctgcatcttcaaagtaaccattttgaactgtcttggtatcctctgctttttcaggctcgattgctgggccttcttggtccgttgtttgtttcagagccttgaggtttttctccatgatagagatgtaattttctccagccttggtgtcctcttctgtcagactttctaaaggattaaggacatctgttttgacacctgcctcttttgaaagtgtattagcaagggcttgtgaagcattctcctcaaagtagatataggcgattttatttttcttgacatactctgtcaattctgccaaacgagcagctgatggttctgcatctggagaaagacctgagattgatacttgcttgagaccatagtccaaggcaaggtagttaaaggctgcgtgttgagtcacaaagctcttttgtttagcttgagacaagccttctgcataagccttatccaaagcttgtaatttttcgatataggcagcagcattcttctcaaaggtctcctttttatccggataatctgctgacaagctatcacggatgtgctctacaagtttaatggcacgaaccggtgataaccaaacatggggatcgtactcatggtgatgtccttcttctccatggtcatggtctccctcttcttcctcgctacctggtaagagcaacatatcgcctgtcgccttgatggttttgacctttttcttatccaaggtatctagcaatttagggacccatgtttccatgttttcattttcataaacgaaggtatctgcatcttggattttggcaactgccttggcagacggttcatattcatggggttctgtcccagcaccgatgaggagttctacattagcagtatctcctgcgacttgcttggtaaattcatagacagggtaaaaggttgtcacaatatttagtttgccatctgcctgcttttgattggaacaagccactaaaaacaaggcacatagactggcaaacaataagctaatttttttcacgttagtctcctatttgataaaacgtcttactaaactaatgagtaaaaagacagttacaaaaataatggtaatacttgcacttgcaggtgtttctgcatagtaggaaatgtaaagtcctgctaccattcccaaaaatccaatagcactggcaagcagcataaccgatttaaagtttttccctagacgcagggcaatactggctggcaagaccataatggtcgataccagaagagctcccgcagctggaatcataagggcaatggccacccccgtcaccatgttaaaaagaatggacatggtacgaactggcaagccatccacaaaggccgtatcctcatcaaaggtcaagatatacatcggacgaaggaagaggaaggtcaaaatcaaaacaaccgccgcaatgacaaagagggaaataacctgctcttcactgatagtcacgattgaaccaaaaagatactggtccaaactcattgagctagagcttttacccttgctcatgacaatcagagaaacagccagacccgttgacatgaggatagctgtcccgatttccataaagctcttgtaaaccgtacggagatactccaggaagactgccgcaatcaaaacaatggcaatagtggaaatagtcggagaaatccccagaaccaaaccaaaagctacacccgaaagcgagacgtggctgagggtatcactcatcaaactctgacgacgcaagataaggaaggtccccaataccggcgagaaaagactcatggcaataacggccagaaaggcacgttgcataaagtcataagataacaaactaagcatggcccacctcctgatcattctcatgaacgttgaaacaacgccatggcgagtcttggttacggactagatgaatattgcggtccgcatagtccttaacttcttcagggtcatgggtaatcatcaaaacagccttgccatgatgatgggcgctgtggtgcatgagttcgtaaaattcgtttttacttcctgcatccatccccgttgtcggctcatctaggataaacacatctggatccgaagcaaacatacgcgcgatcaccgctcgctgcttttgtcctccagatagagaccccaagcgtttgtctcggtgttcccacattccaactgagtccagactagccttgatatgctcctcatcatgagcattcaaacgacggaaccagccttttcgcggatagcgacccgacttgacaaattcataaaccgtacttggaaaaccagcgttaaaactggcaatctgttgaggaaggtaagctattctcaatttcttaccctgcgtatttgtctttgaaatggtcacctttccaatgcgtggctggaggattccaagactggccttaatcagtgtcgtcttagctgctccattttcccctgtcaaggtaacaaattccccactatcaacactataattgatatgttcaagaacgggctccttatcataatagaaggataaatcctctaccgtaatgtatctcattatttgatttctcctactaaagcagtcaaaaaccgctgaatcactttttgttcatttggagtaaactgagttgccacttgttcataggttaaaagtgtatgctcatggtgatgatggtgctcctcagcgattggacgagccaaatcagtcaactgataaaaaatcacacgcgcatccttaggatctttagatgtttccaacatcccttccttgaccaaagacttaatggccttggtaactgctgcctgactgacattgaggcgacgcgccaattctgaatttgttaaagattcctctgacaagagcataagaatgtgctcctgagtattggtcagggccacctcgctagtacaatgacctattaggatttcatgctgattttctgcctgcaaaatcacctcattcaaaaaagcatcgatatccttcgctagctgtctcatatctgactcctttccttttgaacttctcttttttaagagaaaaatactattctttgaaattatttactggttaattatatcacaaccaaaaaaagagtcaagaaaaaacgtgaaaaccagtttcattcttgaactcttctatattatgatctattgaaatgccttgacatctccatcataagttgcccagtatctaattctattttagaagacacaacactttttattcaaattatatataaaatggagaagagaaaagtcttctccaaatacatactttacctcactcaagaggtctagaatttataactagaaactcattaaaattttgaacaaattttactcattatccttcttacgaagaacgatacttagaccactcaaaattccaacaaatccgaatgctgccaaggctgcgttcgattccgtaccagtatttggcaattgagctacctcagttgatggagctggataagtgtttccatccggattgtaatttgaaggtactggtttgttcggaactgccggtgttcccgaatcttccgccacaggtacaggtggttttggagtctcgtttcgttgaggtgttggagctggttgtggtgtaggtgcaggagctggagttggagtcggaattggatttggctctggctgtggttttggttcttcaggaatcttcagctctggaatctccacagttggcggatctaacggaactactccaccttcaaattctggcacttcaacttttggagcatcaatttgcattacatattgataaacaatagtagtaacaccttctttaaccaatcctttttcttccacagtatttttaaacttatcacctgctggaagaacacgtttcaatcggaatgttactccatctactacgatagtttcaggagctgtcacagcgtactcttctcctgtagctttgtaagtcgtttcttctttatcaccagtagttatagttgtcgcttcagctacaatgacattgttcttagcgactacgtcatctgcaaggaagttttcattaatatctacgaatttaacgataactgttccttttttatcttttgcgtaatcacgtacactgtttggtttattctgagaatacttaacaacaaccgctgaatctttagattcatgtgttacagttaattcatctacctttgctttatccacagtgtaatctttgatttctggtgacactacttcaacaagtttttgttctggagtccaatctgttgtgtacgtcacttcaccagttctactgttgatttcggcagttcttgtgaaacgagcattttggttaacaggtgcacttgcttcctgacctgcttttggtccattttcgtatacataagtgatgttacgtttcacttctgttagtaaacctaaatctttgtaggtgcgaccttttggatcgttaggaattttatcctctggttttggaggattttgatcaccatcgttaggtttagttggatctactggaataatgtagtcatattggtatacaactgtcgtagttccttctttcaccttacctgtttcttctgtagtattattgaatttatcagaagcttcatatacaccgctgtatttgtatttcttaccattagcttcgataacgtctttacggttcgctacagtgctgtattcttcatttgttgctgtataagtagtttcttcacgatttgcatagacttttgtcgtagctttttctactactgcattatctttaacagttacctcttcactgatttcatttccttgagcgtctacatacttaacaactacagaaccttttttgtcttttgctgcatcatgttcgataatttcaggattttcacggtatttaacaatttcgctactgtcttcagattcgtgcgttactgctaattcagctactttttctttatcaactgcatatttatcgatttttggtgacactacttctgcaagtttttgttctggagtccactcgcttgtatatactacctcaccagttctactattgatttctgcagttcttgtgaagcgtgcattttggttaataggtgcacttgcttcctgtcccacttttggtccattttcgtatacataagtgatatcacgtttgacttcttttaagagacctaagtctttgtatgaacggttttgtgggtcattaggaatcttatcctctggttttggaggattattatcaccttcattaggcttagttggatctactggaataacataatcgtattgatatacaactgttgttgttccttctttcaccttacctgtttcttctaatacgttgttgtacttatcagaaacttcatacactccacggaagacatatttcttaccatctttagtgattgtatcaactttcttttcaacagtattgtagtttacatcattttctgttacttcatcacgagtcgacagtacaacctctcctgacttagtagcgtatgttttcgttgttttaacaactgcatccgtcactacattcgcagaatctttgatttcattaccatcagcatcaacgtacttaacaactactgaacctttagcttcagttacagtcggtgttgtttcctcttgtttatctagagtatagctgtagataacgtgtttctcaccttctgtcacgtcccctgtcgctggagctgaatcagatgtttgccctacatatttataaactaatcctgtagcttcatcttttagcgttgggtattgtttatcagtagtgtcgtatttttctgtaactgtacgtttttctttacgttcagatacttttacaccttttgagtaagttacataagtatcttcatactcaactggcactttatctttcactacttctgcttcttttaatgtttttaacgttccatcttcattgatcacaacgtgtttcacgtcaacagaacctgtcttagtcacaacggagctagacggagttttctcttcttcacttactagacgatattcgtaaacaacttctgtagttccttctactactttaccgctagcagctggagaaccttgttttagacctacatactcgtatgtaaatccagtatcagcatccactaaggttggatattgttttggagttgtatcgtagttttgttctactgttttaacatccgtacgttcatcaacttttgtttcacctgaatataagcttacgatagtttttgtttctaatgtaacattatctttatcagtttctgattttaattgttttccatcagttgtgacatacttaataacgacactaccttgtttagaggctgttgtagtacccgcttcttcttttgtgatttttaagttgtaatagtgagtgacgactggtttttcctcacccattactttgtaagcacggattggtgtgataatttcttttttagtgaatgtcgctgattcagttgtctctgtacgagttcttgtaccattatcaccactaatgatgtatttattttcagcaacagtttctgtaggaatatacttttcatctgttacttttgcatctcctgtaactgttactgtaccgtctgcagcaatttcaacttttcctttgttaactaacgtagttacagtcgtttctttatcaggctcagtttcatctaatggaatatagtcatctggcttaccagtataaacagtgtactctttaatgtttttagttgttataacatcaatgtaagcgtgtggagaataatcatctggagtatatttatatactgtagtcgcgtggatttctctatatgtgccattgttcaattctgtagtatctgtaggctcatttgcagtaaccgatacttctccaataatttttggaaaacctgctaaaagttttttgaatttatcaacagaagcatctgaaatatatccagtattaaggtctataggagcatgcaaaacaaattccccagcacgtctcccagtttttatcaatcctagttccaatttcccagattggatatcatcttctaaagtttttaaatgagcatctaaacgcgctttagccgcttgaactttctctcttccagttgcatctgtcgctttaccttctaagaattctaaagctttataattagcaattgtgtaattttttaaaatatcttttaatgatgattgtgatttatttagtctataatcataactatattcatcgcctgttgctaagttttttacttcagacccagcatacccacttccaaaacctaataatgcgtaagttgggtttccactaggcgttttttctacatcatcagcagtcccataaattccatctgcaccaggtgtataataatggttgactttaggtccatcaaaagtatcgtcctctacaatataagttgaaaaagactccttttctttctcttctacttctatttttctttctactgagaaagtaattgttccttttgtgattttctttacagccttcccttgacccactgcatacgtatctttatcaagaacaagaactgtatcaccttcttggagggttacgttttctttggtaaactctttagcgtcagcttgaccatcttgccattttgtaacagcatcttcatcgctagttactccattatctgctacaacatacttaccgtattgtccatcagctgtctcttccacaagatagactttgccttttgttttagtatagtcgatttcccctagtttattatgcattccctctggagacactgctgcttcaatatcgttaaaacgagttttatcataagtaagcttatcagcaccttctacttcagattttccagcgtactcataaaccctaccattcgcttctacggtgtcttttttaccagtatctttagacacaacagttcctggttgagtcacagttgattcacggtagtctttaccatctttatcataagcaagaccttttttatcataaggagttgtaactgtacctgtcccagctgctactgtgtctttttttagtaatgatttatcagaatccaatttgtaattgacagttgcttctgatttaacatttaacgtatcagtcccatcagcatcgcccgtattgctgttggcttttgtcggttcagcagttcctttttctaataccgcatctacttttactgttttagatgcatctttatcatctgtaaaagttgtggctgatgttgaagctactttcgatgtatcggtcaccattgtagcagtatctgtaccattagaagtaacattagcagctactgggcttgcaccaacagctaaagccacacctgttgccaaaatcgttgcaccgattaacttggaatctgttcgaccatctttatacttacgaagagaaaatttctcctgtctatcagtatgaaacataaaacatcgccttcctaaaatttcattgttttttatattttgaatctataaaatgtgcgctaagaactataaaactaagaaagttttacgctttcaattatatcatatttctaaggataatacatacttatacatatccagaatttcctttttttgataggccttagagaatgttgctgacgagtaacgaccttctttttgataagcaatgagccacaagagtaactccccaatgtcaccaaatgttgtgacacctttggactgactcttatagtatctatgagctaaatctgtatcagacaaaagacagatcaaccccctggcagatgcttctacagccgcattggcaaagcattcactcatagaacaagagagatagccttggtgcttttcataagggacctcttctagaaaacctgcataatggacattcgacggcaagtctttctggctatagccatctggtaagttaccataaatcgttaactggctatccggcacttgccgaaaagcctcaatcgcccaggcacaccgttttatcatcgtcatattgccaacgatacaccaatcggtgactcttgtatattctttttccaaaactccatccacaaacattggaggcaaaaaacaaaccttttctttccctattagttgctccaaaactggacttgcaacgatattttggcaccacccttgcaagacaaacttcatcatgggatctaggatattgtagtgagtataagcaaataactttcttccggtattttggaaaaatttcctcaattgaagaggatattcattgaccatatcaatgataaagcaatctttcactgtagaattgttggctagatagagactaactaactgccattgagtgtaggtttccccacttcttaggttttggtaagaatggtaattttcactcacatcaccttttagcaactcccctttactatcataaagagtaaaaagattttcttgatattggaatcgatacagtaattgagaggtataacattctacatctccattttgataatgaacgagtcctacatatccctcttttgtgtactcgacttcactgacattaactagtccctgaataaatgatttctccacaatcggattttgtctagccaaatctgattgatcaaaaataacatgatagaagttttcaaaaccaagtttttccaatgtttctacaaaattcggtacaaaattatccagatttgttaaaacaatttcttgttctacttgcagacttttaaaaatttcttgacgcgccaattgacttctttcaaagccataagtgcttataggaacgccttcctttattgtaaatactttcaccatagtttagtccaatacatcttccaatcttaatccacgacttcttgctagtcttgcacggaaagccatccctcgtttatgacgttctgataagcgatagtaggtcgttgtgacatttaaaaccagggcattatccttggtaaccatacgagaccacaaatgccaatcttcaaacccatcacacttagcatcatagcctcctgcttcatcataggcagagcgtttaaaaatgacggttgaatggttaaagacattttgataagcaagctctaaccacaatttttctcctgataaatgatgagattgattccgtttaattttatctgttatagcatcttcttctgcgacaactctagccccgataaggtcgagttgaggatttttctctaactcctgcaagagaagatctaagtgccaaggcatccatacatcatctgcatcttgtctggctacataagccgtttgagacaaactaactccacgatttaacgtttctgaaatccctttatgatcttccctaatatactgtattcgctcgtctactagatatggcttacatacttcctctgtattatctgtcgaaccatcatccacaattaacagtcgaaaggcttgatgggtttgatttaaaacagaatcaatcgtttgactaatggtttcagctccattatagacaggcatgacaatatcaacaggtgtgtccgattgagacacattttgatagggcacacctcgttttgcaaaaacatttgattcatgagttgttaaaaaggtccgatacccatgaaccgatacaccctctatatctttgaccaataaaagagaagttgagtaaaaaccatgtacctcaacgaactcatactcctctagcaaaagataaatttcttcttcaaagcaaaatctagtttctttcaatttatcttgataaggattcaaaggtactctaggatggggatagtaataatcaatcttctgttcatctaaaactttagcagtcaatttttgagtaagttccaaatcttcctgataaaggagagagcctaaaaattgccccagaaaaatacttattttcttaccatttttagccctatgaaaatgacttggttcaagatgaagctttagaaaaaactgctgctcttttgggaagaggatacagtcctcaaatacggtataatgtctatttgacaaagacataacctctctcaaggtaaagtttgtataaggaatgcccctctcaagattttgtgtatacagattgagaggtacaatggaagtactaccatcatcaaaagtatacaaattcattgtactgggattaaagatgctaagagctacaggattgtctaagcttgctagatagagattactaatggccctatcttttaaggcttcctgaatatcattaaagactgtttttccttctaaaacaaggacttccttacaaaattcttccattcgttcagcataaaaatcctgtctcgaatcatttgacatctttagataaatcccgataaagtcttctgagacagtctgtacaacttctttagcgactaaaacctggaagggagacgaacaaaaaattatattctccaaatttaactcctcataacattcttacaaactcttacttagcatcttgcttttgtgcaatcatctcttgccaccaatcttcatgttcttgataccaatggataacttcttttaagcctttatcaaaatccacgtagagaggtgtaaagcctaattcagtatataacttactagcatcaattccataacgaaggtcgtgtcctggtctatctgctatatacttgaaatcttcctgagattttcctaactgcaacaagattttctgtaacacttcaacattcgtgcgttcattatttacaccaatcaagtaggtttcaccaatcacgcccttatcaataatggtgtcaatagctcgacaatgatctttgacatgaatccaatcacgaatattcagtcctgctccatatagaactgcctgctgtccagttaaaagattggtgatttgccttgggataaatttctcaggattttgatagggtccatagttgtttgaacagttggaaatcgtagccctaaccccaaaagaacgaacccatgctttcactaatagatcagcagaagcctttgtagcagcatagggagaacttggattgtactgcgttttttcagtaaatttatccttactttctaatgggaaatccccataaacctcatctgttgaaatatggtggaaacggatatcatacttcctagctaactctaaaagattgtgcgtcccgacaatattacttttcacaaaaacagacgtatcgtgcaaagacttgtcattaaaagattctgctgcaaaatgaacaatcaaatcaactccttcatcgatatagttgcttaatgccaactcatttgcgatatccagtttataaaacgataccctatcatccaataaatcttcgattgttttcatcgaagaggcgtaagtcaaattatccaaaatcgtaatctgaatatccttataagtctcttttaggtatcgaacaaaatttgaaccaatgaaaccagctccaccagtcacaacgatatttttatagttcatctattttcccttttatatttttcactcaaagccagtacggtcaacacttacaacttcccattctcttgtatccgcaatttgttttccattttgttcaagtaaagtattaaaatcaggaacaaacacttttacaaaaggctttgtaagtcttaaaatatagcctacccaataacaataagtcgaattgggacaaatgaagtacttgttacagctatacagttgtaaaaagttatcttgaatatcctgctcctcaactataatcgggttttcaaaatggtactgagagtttagaaaaggtaccaattcttcatgacaccaggcaacatcatctgaagtaatacgtatagttaaatgttgaaaattatccccttcaattgctgctatcttctctaaacaagaaccgatatacaattgagcgttataaccgtaattttttctatttcgttcattgagaaaatccgttcttctaatagcaattgtcacattcttctcttcaaattgagcggaagaagctactactggttcaatcaaatactctctacaaaaagagtccaattcttctgaagaatagtcaacacctgcctcttgaaaataaccaaaatcttctaattcgataccatttgcttttgaaaataagacagcggtttttggaaaaaaggtttgggcaaactgaaaatatcctgttcgtaagacataactttcctcataacccatcatccgatctctatgcgcttgtagtaagagatagagcaaatttcctagttgaaaacctctattattttcataaattttcaagattaaaatctccttcttgctttttaaagtatcgtcctaaagtagaattgtcaggattttttaataaattctttatttgtctacctgtaaaaatttcagacttatcgatacccagtttcacgccatcgattctatttaaattcgccatcagatggctgactaaatcatttattgccgtcacttgatagcacatttcatcaggataaatatcagaaattggctctaaagtacttaataattcatttggaagaggctctactagagaccacagctgatcatttactttttgataatagttttctaactcaggcttatccaaaacaatatcatttgaaatataagtccattgtctagaaagcaaatcgttaataaagccctttttcagcgtttttccatataaggtgtccataatataaatagtattgctattttgatgagcctcaatcacactattataaatcttttgatgaatagcgctatatctggcgccactatcaaatacagatttagtggacactaaaatcatatgacctgtctgaatattttttaggacatttactaatttctctatttccgcatcatcgtttttcaaacttaaattggttaataatttttctgatgacggagcggtacaaataaccatatcataaaaatctttcaaagcttcttcaatattatttctattgaaacaacttaaatcaatatcagattgcttccttaatgtatcaaataaaactttcccaactgcacccgttgagccaattaaggcgactttcttcttgcttgattcaattatttcaagaacttctttgaaagatttagcagcttggtctttttcagaaatgattggttttaaaagagaatcccacgacaaattagcgtctttgtctaatggtgtaatacctaaatagtttttatgtggatcataatagtcagcaaccaaataattcaatattccattgttaactaacgactgtgcaccattagccactccaccagggacaaaaacagccctaccaggttggacatctatcacatctacagatttgtaagttggagaatctattcgtaggtcgataaaaatcattttgaaagtaccataagctactgtcatcaatttttcatagccctgacaatgcatccctctgataactccctgctttgaaacagacacattgttttgaagtttatgatgaaagaatgattctggcaccccatttgcaagcaaatctttctttcgccaattctctaaaaaatagccacgctcatcatgatgaagaggactttcaaacaccaacaaaccttgaatctgcactaaaatagttctatctatatccatcttttcccctctatattgtaatgcatccacactaaagctattttcattatgtttcttaaattataccactatatgagttctctagccagatgaaggtcattctttttaaacactcatatctataaatacacatttttattagcataaagaaaaaccctaaaaatcagactgattgtctaacttttagagttaaatcgtttattattttgtcattcgtctattgaaattccttgacatctccatcataagttgcccagtctttactgaaaaagcgctcattcagatggtacatcggagctggagtgggattggataggaaaggatcaacggccttgtcaaatgccaaccaacccaaccaacccagatgaatggtatccttcataaagaaagcttccccaccgtccttagaaaaatctgctatattggtaaacccttgactttctaactggtagcgaatcttctgcaccgtttgttggtacatatcttctcgtaaaccagcatagtccatccattttttattaacaggtggaatgataaaaatcgggtttaccttggatttagaaaactgtgtcaacactaactgcaagtcattatattctggcgacttgagataggtaaagtttttctgagaatcctttaatttcttcaaatccttcttaatctgcgtattatagaaataattctccattcccaaatcattattagaagtatttttttctgcatctgctttaacaacatcttctatggcttgataagaaaactggtctggcaaggtctttaaatacttaactacatgcttatcataattgacatagcctctaactgaaaactgaccaaaaaaggaagcttgacgttcattaaaccgagctaataattcaatcatttcattgtctgcagacgacaattcttctttacttgccaacttctgaaccaggtccttcatagctacatttgggaactgctgtagtaagcgagtcgctgcatattgactagcctgatccccagattgatgttccagaaaactggtcaactggtctccattaaaatactgctgaaaggctgctggctcatagccatttttactaaaccactggggcgagataacatatacaacttgtttattctccagttgtggcaacatctgttgcatcccaaaatactgattgagcgaggcagctcccctctgtcctaaaagataggggcgataagagcggttgtatttctcagccaataccgcaggatgggcaccgtcaaaacgaagccattcactggagccaaagaagggaacaaaacgcatatttggatcagatagtgctctgaccttttgacttcgctccttaaaactatcgatagtagtagccaccgccgaacgcttttcagctcccagatcatggcgcatctcagcaggatagaaaaagataagcagaaaaaccaacaaaccagctatcaagaccggtccgaagatcatccataagcgtttaagcattttgtagctccacaataccagctatgattttattggctgtattccagtcgtcacgaccaaactctgttacagggacacgaatatcaaaacggttttcaatctccacaatcaactcaaccgttcccatactatccaagacacctgcatcaaaaagatcttcatccatcatgtcagaaacatcttccataaacaactcatcaataatttcgataacttctgatttgatatccatattttatttccttttattttttaaaccataaatcattcaagaatccagaaaagattaagaatgacagcataacgacatggaaggtgacaaccatgccaagcaactgaatccagcgattctcaggtagagcagctttccctgcttttttccgttccttattgagcgtttttttcttacgaatccaagcgtcattgataaccagtccaatcccatgaaagagtccataggcgatgtagtaccaggtcacaccgtgccaaaatcccataatcagcatatttacaatgtaggccacacttgaggttacattgcgattcttaaagaccttctttctggtcaacaccatcaccatccgcataaagacaaagtcacggaaccagaaagacaggctcatgtgccaacgattccaaaactcttttaaatcccttgataaaaagggcttgttaaagttgataggactacggattcccattaagtttgagatagctaaggcaaacatagagtaacctgcaaagtcaaagaaaagttccagaccaaaggtatacatgaccactaaagtatagatattaaagaaaccacctgactgcagggctagattcttcagaggaggcaacaaagtctctcctagaatatgggccaagataaacttgtagagaaagccccacatgatatagcgaacagattcatccagcatatccatcaactcatcccgctcaggaatggtctgataattttcattaaaccgcttaaagcgatcgattggaccacttgaaaaggtcggcatgaagagaaggaaacggaggaattcccagagggtaaaatccttaatcactccatctctcagctcgatgataatcccaaccgaacgaaaggtcaggtaagaaattcccaaaaacccaagcaaagactgcgttccattgatagccggctgcaccttgacaaagataattggaagcagggacagaaaactaactaggtagaagacccacttgccatccttactttttcgatagtgcttatagaaaagcaagagcaatatttcccaacaaaggtaaatacccaaggcagccaattgattagtcttcccacctaccaacatggtgacgataaagaagagactaaccagcacttcataccaggcaaagcgtttcttgaaaaagagaccgataaagatgggcaaggttgcagcaatcacatagacaaaatactgaggattgccgtatggctctaaatgaggaagctgttgaaagaactccatcatctcttattcacctcgttaatcaatcctttgatgtcaatttttccatttggagtcagtggtaaactgtctcgataaaggaatttagatggcatcatgtaggacatcatgatatctgttaaatcttccttgatagccttggtaatatcaatatctcgctcaaactgctcacgaacaccgtctttcaagatgacataagccaatagattttgcaccttgtggtctttattataacgtggcacagctacagcagactcgataaagtgagacttattgaggttttgagagacatcttctaactcaatgcggtaaccgttgaacttaatctggaagtccatgcgtccgccgtagagaagtaagccttcatctgtcatagttcccacatctcctgtatggtaggctggtagaccttcaaactcaaagaaggcttctgccgttttttcaggattgttcatataaccttttgaaacggctggtcccgaaacaatgatttctccctgttcgccatttggcaatttattgccgtcctcgtcaatgataaaggttggagaatcagccttggtataaccgattggtaggcgtttgagagtcgctagcatctcgtctgtcacagcaacagctgacagggctactgtcgcttctgttgggccgtaagcattgataatacgggcatttgggaaacgttcgcgtagtttttgagccgttttaaccgtcaattcttctccatcaaagtagaaatgcgtgattccaggcattttctcactattaaagtcttctgacaacatggccatatccgcaaaagaaggcgttgatgtccagatagcgattggcaatgaaaagatggtcgcaaagagttgcttaaagtcctgagtaatagctgaaggaagggcaaaaagtgtaccacccagtgccaaggtcggtgcccaatacatgacagacaagtcaaaagaataagggggctgagccagcatttgcggacgacttggcgtcgcaaattccttgtccgtaatcatccagttggtaaagctgaggagattatcatgtgaaatctgtactccctttggcttaccagtcgtaccagaagtaaagataatgtagtagttatcatctcccttgactggatgcgtgatctcatatctagacccttgagcaaaggcttcttgaacctgagctagagtcatcatcggcgtagaaacctgctccaatgggaagtctgaaacggcaataatcaaacttggctccgctacttctaaaatagctgaaactcgctccaaagccgaatggctatcaattggaatgtaggcatgacctgacttagtcagcgctacaaaagttgccaacatttcatattcttggccaccaaaaacaaccacaggagacttctctggcaaatccagttgatcaatggctgcagccaaactatccgaatcagcctttaaatctccataagtgtgttcctgccccaaaacattgtaaacaggatagctaggctgtgtctgagcaaaatgctcaatggtttcaatcatatctactattggtttatttgacacaataggaattctccttcaagttaaaattcattatagataaagcttccttgaccctgaccaagatagctaaagaagtaaagcagccccagaaagataagaaaatacaaggctgtccgaccaagaaagaggtacaattcttttctctgtttcatcaagaaaaaccattcatttctgtaatttttgctaaataagatagactcttactatagtatttttctaccattgtaccactttataggctagtttttcaattgtttaccgtacattttcactagatttcagcttattttaagggttatgcgctttttctatgtatatttcaagtagagtgatactgtttcaaaactccatttcatgagaaaatgaaggaaatcttcccataataaaacgcacgatatcaagttttttcaacacctgatactatgcgatttgctgatttttaaagactttttaactagtctctcatttaaaataatctcgtctgatataaattaaaatagcttctatcaccagacaaatggccgatatccaaaaactgatactaataccaaaactctcagtaatatagctcattagcaaaacaaatactgaaaatgctagtgtcgaaatcacttcaagaacggaatagacattaaccaagttattttcctctactgtttcctgaagaaatacactttcaggaacttcttttagttgcgataacataccaactaaagctgaaaatactaaaaacatctgtgcatttggaaaatatagaatagtcagtgtcactattgccatggctacaagaggaaaaagaatactttcccatttagcagcaagaaacttttcagatagccgaaaagcaattaagccactaattataatcccgatagaatatgctgtattagaatatccccagtaactttccgtttcatttaataactcagttacaaagacaagtatgatagacgaaacccaaatcgtatttgagaaaatttcaaataaatttgctgatacaaaaagtcttaatctaggatctctagcaactaacttccaacctttgagcaaaatttcaagattggtctctgactctagtacctccacttcagcgttaggcagaaataacatcagaaagctagaaatgatatacaagattaaaatgataaacgtggtaggcaacagaccaattgttgcaaacaagagtccacccaacccccaccctaccaattgaacagcttcaccagtcattgacaaggctgagttagccttgcccaaatcggtcgcatagcgcggcacaatagcataggaaacgggtgctgcaaaaccatctaatatggaaattgcaacaacaaatagatagatcaccaaaggcgctactgattgcattacggtaaacattcctaccagtatcgccaataatatagtctttccaaattgggataaagataaaaccctatttagcgctatccttttagtaactaaaggaactaaaagacttgcaacaaaagaggatatccctattaaaatgggaactagtgatgtggcaattactgattttgaaataatgtatatgttagcaatgattgttactctaaagaaaatatctgctaaatttgcaaacaattgagagactaacaatttgataaatgaattagacatatagctctcctatcttagttgccaactttggaattaaaatttgatttttaatattttagcataaaatagcagaaaacaaaagtgaggttttttacatgagaaagcaaaagctagtgcctttattcttcctattttttgaaggaattattatcgttggaggctagctctaagaagttatactcaatgaaaaaagcctgagatactcatctcaagctctattttctaaattagaaaagtgagaatacgagaacggccaaggctgctccgataacaggtcccacaacaggaatccaggcataagaccagtctccgtctcccttgtttgaaattggcaaaatgctatgcatgatacgaggtccaaggtcacgcgcagggttcaaggcataacctgttgtcccacctagtgatagaccgataccgacaatcaaagtccccactgcaaaggttccgattcctgcttgaaggtcataaagtcccaaagcaaagattgtcaataccaatacaaaggtgccaaggatttcgctgatcaagtttgatacagtatctttgatggctggtccagtactgaaggttgccaggatatttcctgcattttcttctgcctcatagtgaggtttgaattgcaaccaaaccaaaatctgaccgagcatagcccctgcaaactgagctaggatgtaaggaaaaacggaagcccaaggcaagtcaccttttaaagctacaccaattgtcacagctgggtttaaatgagctggactgagcttgccagatacaaagactgcaaccgcaactgcaatcccccaacccatagtaatcacaatccaacctgagctgttgctcttggtttttggaagaaccacaccagcaacaacaccatttcctagaagaatcaggattaaagtccctaaaaactctccaaataattcattcatcatctttctgtctccattaaaaagaaggagagggtagactaggagtcctgccctccgcctcttttattttttcttaattttttaattctgctaaatcgttgttagcgagagccgcttcgacatccgcacggtagcctgctttttcttcttctgtccagtcatagaatcgtcccatttcatccaaaactggctcaacgatgctatccaaactatcacgcataaagagcatgtggttggtacgacgaagaaggaagtcaactgggctaagagccaactcattgcgcattgcatagtgaagtgacaaagtgtctgccaaactgagtcctggcgcttgttccaaactatgagcaagagcaaagactttcggtgcatttgaaccgtagagatttgctaggtaatgagcttccttgctatccaaaccacgtgacactccaagttgcgcaaaggcttcgatttctgagtccacatttgctgggttcaattccccacctgaaacagggtaagtcttagaattgatcagtttaaagctacggtcaaattctgctttgaggatgtcaaccacgcgctccatagctccttcagccatcttacggtagtctgtgattttaccaccagcaagggtcaagagaccattatcatctcggtccaagctcgaaccacgtgaaactgcagatgggtccaaatgtttctcagatgtgctactttcaagcttgctgacagcagcctcaacatcttcacgcgttttttctttagagagataagattcaacagtcgcaatcaagttgttaaagctttcatcactgatggttccgttatttcctccattgtagtcagaagcgctattgcctgcgatcaatggacgaagacctgcccagctgctttcgatatcatcaatggtgatgttggcttctgggaagcggttgttgacaatgccaagtaggtaatctacatcttcttgagttacttttggatgttccaaatcacctgtgtagtctgtatcagttgtaccgaagtaagtcttgttttcacgtgggagaacaaagaccatacggccgtcacccaaacctgtgtcaaagtaaactggctgtgaaaccttgattttgcttgaatccacgactagatgaactcccttagttggacgcatttgtgagaattgggttcccttattagacaaattgcgcaccttgtcgctccaaggacctgttgtgttaatcaccagacgggccttgatttcaaagacttggtctgtcaacaaatcacgagctaccacacctgtaatcttgccactttcgtcaaataggaaaccttctgccttcacgtggttagcaatgagggcaccgtcttggttggcacgtttgatgttttcaatcacgagacgtgcatcgttgttacggaagtcaaggtaaaccccacctcctaccaagccttctttcttcaagtttggctggcgttccaaaacttcttccttgctcaagaccttgttagcagctggggtgttgttaactcctgccaagaggtcgtacaagtccatagctactttcagacggaagaggctaaaggtcgctccatcttcatcgtaaactggcaagagcattggatctggttttggaatatgtggagcgatttgttgaaccacagcacgttcagaaaccgtatctgataccacttctacgtcgaattgtttgaggtaacgaagacctccgtgaaccaatttagttgaacggctggatgttccttctgcgaagtcctgcatttcaatcaaaccagtctcaagaccgctagctgccgcctgcaaagctacaccagcaccggtgattcctccaccgataatcaagaggtccaaggtacgttcctgcattttttgaattgataattcacgtgttttctttgaaaattccatatttacacactttctaactaagtcgctttattcttccagtattagtcgtctacttccgcaaagacttgggttgctttcacagctttcttccagcccttgtagagttgttccttgcgagattcattcatagatggttcaaagagttctcctgtctcattcaagagtttcaactcatccaagtccttccaatagcccactgacaaacctgctaggaaggctgcccccaaagctgttgtttccaagtttttagcgcgtgcgatatcgattcccaaaatgtcagcttggaactgcatgaggaaattgttcatagctgcaccaccgtctactttcaagacttggatagctgtctgagcatccacttgcatggtgtcgatgatgtcacgcacttgataagcgatagattgcaaagtcgccttgataaagtcttctttagttgttccacgagttaagccaaagacagaaccgcgagcgttttggttccagtatggagcacctagacctgtaaaggctggaacgacataaacttcatcgttgttgtgagaatcacgagcgtatttttcagattctggtgaattttcgaccatgcgaagaccgtcacgaagccactgaatggcacttcctgcgatgaagatagaaccttctaaggcatagtaaaccttgccgttaattccgtagccaatggttgtcaagagattgttctcagacaactgcatctcttcaccagtattcatgatgatgaaagaacctgttccataagtatttttaaccataccaggttcaaaggccaactgtccaaagagggctgcctgttggtccccagccatacctgagattggcacttctccaccgtagaaatggaatggaactgtcttaccgtagatttcagagttagaacgaacttcaggcaacattgctttaggaatattgaggatttctaaaatctcatcatcccatttgagttctttaatgttataaagcatggtacgagctgcgtttgagtagtcagtcacgtgagccgcaccgtcagtcaatttccaaaccaaccaagtatcgatagtaccaaagagcaattcccctttttctgctcgctcttgagcgccttctacatgatccaaaatccaacgaaccttggtcgcagagaagtaagcatcgatgatcaaaccagtcttttcatggaatttttccacataaccttggctttttagttgctcagccaaaggtgctgtctgacgtgattgccaaacgatagcgttgtagatagggagccctgttttcttatcccagacaacagttgtttcacgctggttggtgatcccgattgcttcaatttgacttggcttgacaccactttcgatgaaagcacccgcaataactgactggactgagttccaaatttcattggcattgtgctctacccaacctgcctgagggaaaatctgggtaaactctttttgactcgagctgaccttttctccttttttgttgaaaataatggcacgagagcttgtagtcccctggtcaatggccatgatgtatttttcttgtgacatgtgctgtcctcctgataaagatcttgaggatgtttcctctttacacttactagtatacaaaataaagcgctttcttgtttatcaactttttttaattttttaaaaaatgtgaggagattgtgtgaatttcacaaaaaaggcctggaacaaccaagccttttaagtgaataataactgacgaatcgccgccaaatcttccatatccaagtcattttttaaataataaactggtgtctgttccttcttatgaatcgggttattggtaaccagcaaatcataatgccgagttcggtcatagggttcaatggtaataaaacgattgtattccaaataccgtttcaaaatggctgccatccttgaaaagacaagaaaaccagatgtcaaatccagaccaatccgcatatgctgaccaccattttcagccatatattccatcaactgaagccattcccagagaattttcttatccaaatccgtcccctgctgaaaggcaggtagagcatgaaaaatctcctctgccgtccccctaaaatcatgttccatcagcaaataaggatgacgattctccaactggtacttgtagcggtcctgtaaaatatagcccttatagagatagacttgagcacaaagctgactgagttcataggtaacgtgatcctctgtataatcacccagcaactcctccttcttcatttcttgaatcaactgtgtcagcaaatctgccaactgccctccaaaaccaaggatatattccatagtatgaagaggaagaatgcgatgagataggaggaaagagaagaaaatcatcatctccccatcctcagttcctagaggaaggtgttgtccagcaaaaaaggacggagcctttctcagcaaacgaaggtagaaaatattgtcaaaataccctcgcattttctcttctatcacttggaactgacaagcattaacccgaagacgctgttgactgatatgagcccagagaaccaagtccaatttctgacccgaagacaaacttgcaccgcagatttcttctaaagtggcaatctcctgttttctctctggtttctgcatgtgaccttcccattcctgactggaccagaccttccggaaaagacagaaatagaaatagcgaatctgatgctctggacctcgccaacgtccattttggatagataagtcaaattctgacaaaatctgattcaaactagctaagtggcgaccaagcgtagcctcactaatcatcaattcttgagccagctgatgggctaaaaactgttggtggtagagaagataaacaagaatctggtatttaacagcattctccaaaaacaagctccgaatatctctccccttggtagctgcaccgattgacagacgcagattttcatcttctaaggagatagtcagctctaagccactgtccaaagccttgtcattgagcagggtgacatatttggttagagttgcttttgaaaatcctgtttcctccattacagccttgacggtcgtctgagactcttgtaatagaaaggaaaggattgaaaattggccagattcggccttttccatcaaatctcctaaatacatttgttacccctttcattttctaccttaagcatagcataaatcttacaaatgctgaaataatctgtttctctttttattttcatgctgatttcctggtccattatcctaaaaatcagcaaacacacggctccccctttgggcatttttatgctaaaatagtagctatggataaaattattaaaacaatatcagaaagcggagcctttcgtgcttttgtccttgatagcacagaaaccgtccgcactgctcaagaaaaacaccaaacccaagctagctcaactgtagcgcttggtcgaactcttatcgctagccagattctcgcagccaatgaaaaaggaaataccaaactaacagtgaaggtactgggatctagctctctaggagccattatcaccgttgctgataccaaggggaacgtcaaaggctacgttcaaaatcctggtgttgacatcaaaaagactgcaactggtgaagtcctagttggaccttttgttggaaatggtcaattcctcgttatcacagactacggtactggaaatccttacaactctatgactcccctcatctctggggaaatcggtgaagacctggccttttacctgaccgaaagccaacaaaccccttcagcagtcggcctcaatgtccttttagacgaagaagacaaggtcaaggttgcaggtggtttcctagttcaagtcttgccaggagctaaggaagaagagattgctcgctttgaaaaacgcatccaagaaatgccagctatctcaacccttctggaaagcgacgaccatatcgaagccctcctcaaggctatctacggtgacgaggcctacaagcgtctttctgaagaagaaatccgtttccaatgtgactgtagccatgaacgttttatgaacgctctttctagccttccaagctcagacttacaggaaatgaaagaggaagaccatggggcagaaatcacttgtcaattctgccaaacgacttacaactttgatgaaaacgacctggaggaactcattcgtgacaaatcttaacacaccttttatgattggcaatgttgagattcccaatcgtaccgttttagcacctatggctggcgtgaccaactcagcctttcgtactattgcaaaagagctcggagctggactcgttgtcatggaaatggtctctgacaagggaatccaatacaacaacgaaaaaaccctgcacatgcttcatatcgatgaaggcgaaaaccctgtctctatccaactatttggtagtgatgaagacagcctagcacgcgcagcagaattcatccaagaaaacaccaaaaccgatatcgtggatatcaacatgggctgcccagttaacaaaatcgtgaagaacgaagctggcgctatgtggctcaaggaccccgataagatttactctatcatcaacaaggtccagtctgtccttgatatcccccttactgtcaaaatgcgtaccggctgggccgatccgtctcttgcagtagaaaatgccctcgctgctgaagctgcaggtgtttctgctcttgctatgcatggccgtacccgcgaacaaatgtatacaggtcatgcagaccttgagacccttcacaaggtcgctcaagctttgaccaagattccatttatcgccaacggtgacatccgtacagttcaagaagccaaacaacgcatcgaagaagtcggtgctgacgcagtcatgattggccgcgctgctatgggaaatccttacctcttcaaccaaatcaaccattactttgaaacaggagaaattctacctgatttgacctttgaagacaagatgaaaatcgcctacgaacatttgaaacgcttgattaacctcaaaggggaaaacgtagcagttcgtgaattccgtggcctcgctcctcactacctccgtggaacatctggcgctgccaaactccgtggagccatttcacaagctagcaccctggcagagattgaggctctcttgcaattggataaagcatagtctcacatctacaactcacaaaaacgacaaagctcaaaaatgagtcttgtcgttttttatatgttttcatcttgtaaatctaattgcttcactctagctatatagtaggacataatcaaaaacaaattgaggctgataatccaaacagaccattcatgaagaaaatgcatcaatacagccaagctgattgcccccactatgaaacttcccacaacaatcccataatttaaggcttgacgacggtattcttggatatttccttctcttctagcaatgcgatacaaagcggtcaacatctttcggtaatttccagacgtcataaaaatgacatagggatgatcttcaatcaagctacccgtaaatgttagcatcatcattcctgttcccaaagcgatgaaaggaacttctaatagaggagatcgtgaaaagaaaggcaaaataagtgtcccaataaataaaggaagcaacatcttaacccgccagtaggccgttttgcggtattctttcatgtgtagggcaaacagaaatcctagagaaaagaagataattgagcagaatcgcagcatcgtattgatgacatttgagtcgtgccaatcagatataagtaggagaatattccctgtctgtgtcgctaccaaactatggtattgaatatggcaaaacacatccaaagaaccacctacaaatccaagaaatactcccattagtcgtgtgttttgaggtaatattaatttatccgccatgtattatcactcgttttcctttgatttttttattataccactttctcttggagaaactaagtgaaaaacagttggctcactcttttacagcacgatttctagtaaaagttaaagcaccaaattttattattgactcaaagcaacactggaaaccttaccatccgctcctgttgtaatttggatgacttttcctccaccaattttggcattatacttaccatcatcaagagtataagaatagcctttgatagagtaattttctttctttccatcagaagattctactgtaaattgaccacctgatgaaactgtgatggtttcgccatttgctcccttccaattgcccgctgcagctgagaaatcaccatctaccatggttaaaacacccttgtagcgtttattttgctctgcttgtttgtcttgaagtttgcggtcagttgtaggatcatagcttgattggttagattgggcttgaggagcttgttgagttgaaggagtctgagcaggagtttgttgactagccacttcttgaccttgtctttgctctggtgcaggagccgcttgtgatggcgttgcagttgctgaagattgatcagtagacgccttagtcttttcagatgaagctgaacttgaggacttctgagtcttgctttctttgttagaagaagttgctttagaacttgatgactggcttgtcttagcagaactgcttgcttgagttgtttcctttttatttccacaagctcctaatagcaaggtagaagccaatacagttgctgccatcaatttgatataggttttctttttcatttttctactcctttgtaatattttagaaatataaagaaatctttttgtaatataattgtaacattcagttttaaatatgtcaacaatttatctaaactattttaaaaatcttaaatactttagatacatttactcctcctactcttctattcgtaataaaatagaaaaacaggagattttcctattaaaaatttgaatttgtttttgtgtaatcgcttgcatctttaagtacaaagaaatataataacattgaaatagaatataggaggtgcattcttatgctaaataagtattacaagtatcttccttggttgattttgggagctattggctcttatcaatcagcaacttactatgcgcgaactgcatttgacatcttctatctgactacaatctttttgattgtttatatcgctttgttatttttacatgagaactatctcaagtatagatacaaagacttctttactcacatgttgagtaattctaagaaagatagccatccctaaaacagtcgcaacagcaaatcaaactaataaaggcaaataaagagatcgggaacttttcccgacctcgttttttatttcaatcgataggtttttcttggtttctttttaggcactcgtttgagtccgacttcttctacatattctccgtattttacgagaaagttattgctgacgatggggcgaccggggttgataagattgaccagttcagtcccttcgtagacagtgaactcctcctctagcagataaaggaaagtcggattccagtcaagtctcccttggattcgtttgatggattcttggataatggcataatggtcaaaagcgaaggcttgttcctccaactccactccctttaagaagcacttgcctgtctgaaaatcgacatctacaaaaaccacatccttagcatcgtctcctgcttgaacaagttctaatgcacgactaggcagataaaccaagtgggcaatggtcactgtccagccccgggggtcacggccgggggtcgatacggtcattaattgctcgattttttccaaaggaagatcgagattaacttcttctctcacctcacgctgacaggcatgcgcagcatcttcgcccttgtccataaatcctccaaccaaagccaaacaattttgataagggtgagccttgcgacgaattaataagagcttgatctttccttcgacaaagcagtaggctaccatatccaccgtcacacttggtttttcgtattgaggaagttcctgcttgtagtaccaatccaaaaactcctcctgactggcatgaatttcaaaatattctttttccgtcatccctgctggaatcatcgtgtccgtcattttatgcctccttacgaactgccttggtccattggtaccaacctactagactattgagtgtgtaaacccagtacatcccttgaatatggatattttcaccccaccagaggtagatactaaagagattggttgcaatccagaaaatccattgctcacgatagagacgtgtcatcaagagctggccgacaccattggtcgcatcggtaacactatcacggaaagggcgagcactatggatactttggtaagctaagcccataccaatccagatgatagcagtcaaggctaagtacttgagccagtcaaaaacagataatttcttagattcaaagtgagattcttctacttttccttggtcattgatacggttggacagccaagcatagagaccaatcggctgcatgacaaagaagtaaacagtcgtcaaaacttcaccataaaaagtcgcattcatagccaaaaccaaatagatagcagagttaatggccccaaagagataattgcttgcacgtccttctgctaccaagataacacagacaatcccagtccaagatgcaaacaagctcatccagtcatgactttctgtattttgcgtgaattctaaaatcaagggaacacttgacaggacggtgagatacaaccactggaagagactacgtcccataaagagatccttccagagcaggcgcatgattcctgcaaaaccgatcttacgagcttctgcatgaacatttttaaagttttcgataaattgtgtgattttttcagttagttttttcataattttctcctaatctgcttggtaaatggcatcaatagccactttggctgcttcataattgcctaggtaatcctcagctagataaactagtggaatggtggttaaatatcgctctctcatatggtccaaatgctgggaaaaactatgacgaatatggtcttctgccatagtcatatctctaaatccgtcattgacataggagccgaccggttgcacaaagagaatcaagtcccatttttccttagccaagatcgaaacaaagagattatcaaaggtttctcctgataagtccccttggtcctcggtctccatgtaataatcatagtagcccttagttactaaggagttggtgtcagctatcaccaatcccctattggcattactgtcaattaacttagaggtctggtcatactgccccaacaggagataatagtaatcttttggagtcaattcatcgtcgcggacattgtttttaatctggtactcacgtgcgtattccaaactgacgggtgcatcgtaataccttgccaaatccttggccagagtggtcttcccattgctggcactccccataatcaatactttctttgtaaactgacgacggaagggctgagcgatgtttttccaatatttgcttggattttctcgaatcatagtcgctgagattccaaactttctttcttgcaaaacggtctcaaaaccacgatttgataattcttgctggtagtctgcttctcccacaaagaaaattagttcttgctgggtttcatcataggaaatctccgctaacatttggtccaaccactcctgccagcccatagggtagcgaggaagattggtttcatctaacttacaaaccaaggtcaactcgtcaccacgaaaggcctctcggatatagcggaatcttttttgaagcgttaagcctacctgctctcctcggtctccctcatagcctgaaacgacaacccagacctggtcacactgtcgcttcgcacgctgaatcaaatcgatatgtccttgatgaagtggagcaaaggttccaaataccactgctgttttctttttcataaacgcattacctttttatggtttttgatatttttattatctatgtttttattataaactatatttttgttttgtcaatagttttttattattttttataaaaaagtagcaaaaaagagaatcaagattactcctgattctccatttttatacaatatcaaattttaactggcctgctttaacaccaatcttaagtgtgctgcctgcctctaattctcccttgagaagaagttctgccaacttgtcttccacttctgtttgtagggttctgcgaagtggacgagctcccatttctggattgtaaccgtgactagctagcaacttcagtgccgaagcttgtagttttaagtcgatgcccttctctgccaggctagcaatcaatggtttaaccataatcttgacaatttcctgcatgtggtcgctatccaaactgtggaagaccaccttttcatcaatacggttgataaactctggtcgataagtttttttcaactcttcaaagattcgtttttccatattttcctgatcaaaacgaatatccttagctccaaaaccgacggtcttgtcatcccgaagggctgtcgcaccaagatttgacgtcatgatgataatggtatttgaaaagtcaaccttgcgccccttgctatctgtcaagacaccatcatccaagacctgcaagaggacattaaagatgtctgggtgggctttttctacctcatcaaagaggagaacagagtatggtttgttgcgaaccttctcggtcaactccccaccttcttcataccccacatagcctggaggagctccgttgagacgactggctgcaaatttctccatatactcactcatatcaaagcggataagggctgattcgtcatcaaaaagaacttctgctagagccttggccaattcggtcttaccgacacctgtaggtcctaggaacataaaggaaccaatcggacgcttgtgactgcgaatccctgactgattgcggcgaatggcacggctaatacttgaaacagcttgatcttgaccgatgacacgtttgtgcagttcagcttccaagtttaggtatttcttagcatcagtctgagtcagtttttggactggaatacctgacaagcgactcaaggtggtcaaaatatcagactctgtcaccaagtctttatagacaggcacttcctcttcttttgcgattaactgagctgcctgtttccacttaccatctatcaaggccttgtcagctggactcaaacctgaatcgtctgcttttacatgcttagccttattttgcactgttgctgctgcttcatccaagagatcaatagcagagtctggcaagtgacgactagtcaagtaacgatgagccatcttgacagctgtttcaactgcttcatctgtgatttgcacacggtgatgtttctcataagtcgccttcaaaccctgtaaaatgatcatactgtcggccacgcttggctcttcaatcgtcactttcgcgaaacgacgagaaagggccgcatctttttcgatgtgtttttgatattcttcctgagtggtcgcaccaaccgttctcaaagttccacgcgccaaggctggtttcaagatattggccgcatccagagttgagtcaattccactaccagaacccatgatagtgtggagttcatcgataaagagaattacttgaccatcttcctcaatatccttgatgatattattcatgcgctcttcaaagtcaccacggaagcgtgtccctgcaacgacattcatcaaatccagctctaacacgcgcatcttagccatttccgcaggcacgtccccactagcaatacgctgggcaagtccaagcgccagagctgtttttccgacaccagcatccccaaccaagacaggattattcttagtcttccgactcaaaatttgaatcatacgcgagatttccttgtcccgaccgataactggctctaacttgccagaacgcgcttgctctgtcaaatcatgcgtatagtcctcgagaccaccgcttggagtctggggcatgcccatcatattagccatagaattttgcttatcagctactgtacgatggcgttggcgtaaagccttgagatcttcacgagtccaacctgctcgttcttctagatttcgacgtagggcagcaatcttgacctgatctttcttgtcttcataagaaaaaccagctctctccaagatacgagtcgccaaggcattgccatcatgcaaaatcgcatagaggacatgctctgtccctagcaccttagcatggaccactgacgctacatactctgcttcgtcaaaaaggacctgcaaacgatgagaaaacggcaattccgtaaaggtttcatcctggctatagtccgtttcagtcagttccaaagcgacctcttctaaacggtccatctcatatggataatcatttaaagtcgcccctgccacactataactgtgattagacatggcaatcaacaagtgccaagactctaggtaacgagctccaaaatggccagccaccatgtaggcactttcgatacattcattcaatgcttttgaatagttcatcttacttcccttttctatctacctcttgtatgacctgtcgtagcatgtttgcacgaacaactggagcttcttctcctagaacgcgatctaaagctactgccaccagcaaattcatctcctgcttggtcatcaattcctgctcaaccaaaagctgcagaatatcctcataaatttcttgactgacccgctcaccaatcgagtaaagcaaatcgcggagcatttcatgatgactagaaaactcaatccgtcctatgcgaatgtagcctccgccaccacgcttactttcaaccaagtaacctctactttccgtaaagcgtgtcttgatcacatagttaatctgactaggaacaacctgaaaagtatctgccaactgactccgttgcaactccacaattccagattgatctaaaatcgccttgatgtaggcctcaatatgatccgatgtatttttaaatctcattacaaacccacctctctctttaaaccttgactatctttgactattataccgaaattttctcatttttaaaagaaaaagggcgctggtaaaggataatcttcaccaactccctatttttctacttatctaagcctaattctaccaaaatttgacgtttataggcaatcttttggacttctttgtcctcatcttcagaccaatctagtttaatttctgaaacaatctgcccaggtcgatttttcaagatatagatgcggtcgctgagactgagggcctcctcgatactatgcgtaatgatcaaggttgttagctgcaactgcttgtgaatctcaaggtaccaagcgtggagttccatcttagtcatctcatccaaggcgctgaaggcctcgtctaagagaaagagcttgtgcccgaaaaggtaggttcggagcaaggctacacgctggcgcatcccaccactgagttcatgagggtatttatctcttacagctgtcaactggaaggtcgcaaggatgtcatccgctcgggcaacggcttccgccttatccactttttgaatcaagaggggcagaatgatattaccaagcacggtcttgtgctccaagagcagatccttttgcaacatataactcacgcgcccctggggattttcttcaccatcaaggacaattctccctgactgaacttctaaaatacccgcaattaagttgaaaagcgtagtcttaccaacaccacttgggcctaagatagaaaccacttcacctgaagtcacctgcaggttgatatcctctaaaatcctctcctgaccataggcataactgacttgttctagtctaatctctgtcattatttcacaaattcgttggtgaatcctttgtctgtcaagtcttctttaaggataccattttctttatcccatttgtagaaggcattccagcgagctgcatcaaattgaccccatttttccttgtcgcttgcgtattcttttgacaagtatttttgagattcgatgacaaagtcacgtttttccttgagttcaggcgcattcttgatgaggatatcagctgcttcctctggatgctccatagcatattggtagccttttttgatagcttgaatgactttacgagcttcttctttgttgtctttcaaatagtcattgtttgcgatgataactggtgagtagtagtcaaactccttgacatagtctttcaagtacaagaagttagcatctacaccttgagatttggcaaggataccatcccatccatagtagatccaagcagtatcaaagacgccattggcaatcggtgtgattgagtttgagtcgttgtttggtactttttcaactttttcaaagtctccaccttgtgattctaccaaggttttcaacatagcaagttcagttggatcattccaagttccgtatttcttaccaaccaagtcctttggactagctacattgtcagatttacgagagatgattcctgatgtattgtgctcaacaatagctgcaacggcagtaattcctgctcctttttccaattttttagccatgtagtcttggaaataaactgcaaatggtgccttaccgttaataaccaaatcagaagaactttcttctggtggcaatttcaagtcaacatccactccagcttctttgaaataacctttttccttagcaacataaagccctgtgtggttggtatttggtgtccagtctaggataaagtcaatcttcttgagttctgcctccttgttgtccttagaagcagttcgttgaccacaagccacaagcacaacagctacaagagctgtcacaagcgttaaaaacactttccatgttttcttcatttcaatttcctcttttctttttcagaaacattctaattctacgaacgtttccatttaataacatatttttcactaatatcgaccaacttcatacccagaaggctgataatcgataccagaataataatagcgaacatggtatcatactgaaacaatttcttggactgaatcatgtagacacctagtccttcaaagcctcccaaccactcagatactactgttgtgataaaagcgtaggagacactgaccctcagacctgcataaaagtaaggcaggctgactgggattttaaaatgccaaaggatttgccaaggtttggcccgcatcagactaaataaggtcagcatatccttgtcacaatgcctaaaaccgtccaaaatgctaacgatgataggaaaagtagtcgtcaagataatcaagacaatcttaggtaaaatcccataaccgagccacaagaccaggataggagctatggcaatggtcggaatggtctgaacaaccaccatcatagggtaaatcaggtcattgagccaagtcaaactatccataagcacagccatgagacaggcaatcaaaactcccagaaccaaccccagcaaagccactcttaaggtcgcccagctatggtgccagagaaattctctatcacgaacaaaggactggagaatttcaagaggtgtcggaaggataaacttggggagaagtttaagaaaacctgctaactgccagattgacaagactcctagaaagcccaatagactaatgtgtcgtctcagtatacttttcaagtttctcatcaatacttaaaatctctcctacatttattttgacattggcaaagacattttctgcctcctgccctgccacttctagcgcttcttttagaatgcgcataagttcatcaaactccccttccaagactgtttcaaatggtgtcactaccatggtcacttcttgagcttgcagataagcaatgacctgatcaataacagcaatccgatcaattccctgtgataggggtaaaacttgcaaggcaatgcttgctttcataagaacctcctcttctcgttttcctttgacaaaaagaaaaacctttaccatatatggaaaaggtcaagaatagactaagtatcgttccctacgctggcattacccagatcaggtgcggtcgaagtttaacacttcctctcagactgtacacagactcccatatattatatggacatatgatagcgcaaaataaaaaaaatgtcaaggaaactgcttacagaaaagagtaggaaattttcctactcccattttctatactcgttctccgtcactgtttactctgtagccatccactgtagtattaacagctagctcacctgaagagtaagaataataccacttacctgagacttgataccaacctgttttcattgctcctgaactatctagataataccacagaccattttcctttaaccagcctgtttgcatttcaccagatgatttcaaataataccaactagatccatctttcagccagcctgttgatttagacccatttgatttgaaatgataccaactaccatttattttcttccaaccaatagtcaatccattattggatccatagttagaactattccctgattgattctgtgaagaggttactccctctagctggatatagcgacgacttccgttataagccgtataactcaaccacttgtacccatctttttcgagaatttgatcataatgaacattctccccaggataatagtaatcaattgcagttgcgctagctagaggctgatttttgatagcagccttagacttgaaaaaatgtgttcctcctgttgaaggtgaggattgactattcccaacactgccaccagctaaatctttaaaatgaataaagccagtcatggtattggccttcacgacgcgcttattgtaagattctcttattccatagttgtattcttcaatctcaatctcatctcctattacatttgacacccaagcaacatgaccataagttcctgcagtagaccaagcaatggagccaatcgctggtctattatctacacgatagccttcacgacgagcccgatagccccattcattcgcattcccataagcagccggaatctcaaaaccattcacattactcaaacgaaaggctgcaaaagaagtacattgacgagaatacatgcgccacttatcaatctcctggctcccatttttataatgagcaggataatcatccccacgcgcaatcgatccatttcctccggaataggcatatacactattacccgctgctaacatcaatcctactactaaaaagggaacaacttttttagctgattttctaaaagaaaatcctgtctctgctactttaaatggtgaatttttcattcttcctccttgaaaaataatataaatcgaagattaccttcacttaaactattcggagaaaaaaagaaaaagtgagaaaatttctcactttagtcaagataatgaatcaaattcttttctgtaaggatatctgagtaagtaaaggattcaacgtaaacattagcttgtttatctccttcaacgttcccaaattcaacgataaatagggatggataaacctcaattagcttacccaatctatttttttggcgcttacgaccattctccaaagtcatttctacgacttgtccctcatgtgccttgatttcttctttgatttttttcatcttggctacatctgtaaatgcatctgacatcttatgcctccctctttgagatacttgaaaatttattgtattctttttggaaaattaattccaccgttccacgagctccactacggtttttctcgataataacttctaccttattattcggtatgccatcctcttcttcaccaccacgctcatagtaatcgtcgcgataaagaaaggctacgatatcagcatcctgctcaatagacccagattcacgaatatcagacaagaccggtctcttatcctgacgttgttctacaccacgagaaagctgacttagagcgattactggaactttcagttccttggctaggattttcaactgacgtgaaatttctgaaacttcttgttggcggttttctcgcccagttcccgtgataagctgcaaatagtctatcaaaatcaatccaagatttccagtttcttgagccagtttacgagaacgagaacgaatctctgtaattcgaattcctggcgtatcatcgatatagatacttgcattggctagattcccttgagcaatggtatatttttgccactcctcatcagtcaattgacccgtacggatagaatgcgattccaccaaaccttctgccgccaacatacgatccactagactttccgcacccatttcgagtgaaaaaatagcaaccgttttgtccaacttagtcccaatgttctgagcaatattcaaggcaaaggctgtcttaccaaccgctggacgagctgctaagataattaactcctcctcatgaagaccagtagtcatatgatccaaatcacgatagcctgtcgcaatacctgtaatatcagtcgtttgttgagagcgagcctccagatttccaaagttgacattcaacacatctcgaatgttcttaaatccacttcgattagcattttcgctgacatcaatcaggcctttttctgcctgagcaatgatttcatcagctggttgcgaagcctcgtaagcttgattgacagactctgtcaacttggagattaatcgccgtaacatggccttctctgcaacgattttagcatagtactccgcattagcagaagttggaacagaattgacaatctcaaccaggtaagacaagccaccaatattctgtaaatcaccttgattatcaagaatggtacgaaccgttgttgcatctatagcatcgccacgatcggataaatcgaccatagcttggaaaatcaaacgatgggcatacttaaaaaagtcccgagactcaatatattctcgcacaaaaacaagcttactctcatcaataaagatagcccctaaaacggattgctcagctaagatatcttgaggttgtactcgtaactcttctacttctgccatcagacttcccttccttttacaatcttgtcaagaaggtgtaaatttatccttctttcacacgaagattgattacacttgtgatatcttgatagattttcactggcacatcaatcaaaccaactgctcgaatcggagcttgtacttggatatgacgtttatcaatcttaattccaaattgcttttgcaattcttctgcaattttcttattggtaatagaaccaaaagtacggccatctggaccaactttttcaacaaattctacaacagtttcttctgcttctagttgggatttaattgcttttgcttctgcaatcatctcagcatgagctttttcttcagatttttgtttaccacgaagttcacctacagcttgagcagtcgcttctttggctagattctttttgataagaaagttttgcgcataccctgttggtacttccttaatttcgccttttttaccttttcctttaacatctgctaaaaagattactttcattcttctttctccttttcctttatttcatttaatacaatttctgtcagtttttcacctgcttctgacaaggttgaatccttaatttgagctgctgccaaattaaagtggcctccacctcccagctcttccataatccgttgtacattcagcttactacgactgcgagctgagatagagataaatccttgtgtattcttcgcaagaacaaaactcgcttcaatacctgacatagctaacatggcatctgctgccttactaataacaactgtatcatagcatttcgagtccttagcctctgctattagtacatctgaacctaatttacgtccctgtaaaatcagttcattgacctcacgatattcttcaaaatctgttgcagccatttcctgaatagcaatactatcacttccgcgcgttctgagatagctagcaacatcaaatgtcctactagtcactcgtgatgtgaaatttttagtatccaacatcataccagccatcaagacacttgcttgcatacgactcaaacgatttttcttagaattctggaactgaatcaattccgttaccaactcactggcactacttgcaccactttcgatataagtgataactgcattgtctgggaaatcctgatcccttcgatggtggtcaatgacgatggtttgggtaaataaatcataaaaatcttttgataaagttaaagctgtctttgaatggtctacaagaatcaacaaagaacgattggtcaccatccccattgcatccttaacagacaacaactttgtaactccttctttttctaagaatgaaacagctcgttcaatatccggcgacatttgttcttcgtcataaatagcatagctattttcagtcacattgctggcaaacaactgcatacctacagcagagccaagagcatccatatctagatttttgtgaccaactacaaaaacctgatccacactacgaatcttatctgaaatagctgtcatcatagcgcgcgtacgtgtacgtgtacgcttgattgaggcagcagatccaccaccaaaataaactggatttttcgtttcgtcgttttccttgacaaccacttggtcgccaccacgcacttcagccaagttcaaattgagcaaagcaactttccctatctcatcatgatttccatcaccataagaaaatcccatacttaaggtcaagggcaactgtctctgtttcgactcttctctgaaagaatcaataacagaaaatttatcgttcatcaatccctcaagcaccgtgtagtccgtaaatagataaaagcgatccatacttactcgacgggagaacatggcatgtttaccagcaaattctgaaacaaaattggctacaaaactattgatatgactgatatcagactccgatgtttcatcttctaaatcatcatagttgtcaacagaaacaatcccaatcacaggtcgacttgtcactaactcaacagtcgcttcgtattctccagacacatcaaagaaataaagaactccagataccttgtccatatgaaccgaataacggatctcacccaaggtagcataagaacctggattccccacagaagcctttataattgtttgaattaatgcaacatcaatctcgcccacttcattagtcaaaatcaattcagcgtaaggattgaaccattcaacttcacctgacgataagtctagtttaataactccgacaggcatctgttctaacaaggttgtcaaactatcttcagcttggtggtttacatactggatttgttctacttcactctttgagtagtagtctctctgatggataaatagtaaaatatatgaacccaaaataagtagcaaaagaaatagcgttaccagtgtattcgttacaaaaacaagttgcacagatagcactccgaacgccactattcctaatattaaggggaaaataggacttacataaaattttttcattccaaacctcttggcacccattataccataataaccaccaaaaagcgactttttaaaagtgtaatcagtaattctatcaattataagaaaaaggaggtttacaattcagtaaaccttcctttacacatattgaaattaagattctttaacttctaacaagccaatctcgccatcttcacgacgataaatcacattggttgtctgatcttcaacatccacatagataaagaaatcatgtcccaacaaatccatctgtagaatagcttcttccaaatccattggttttaaatcaatttgttttgaacgaacaactctggattgggcaacatttgtatcttccaccaaagcatctgtaaataattgactagttgctaccttgtttttatttttacgctcgatttttgttttatttttacgaatctgacgttcaattttatcggttacaaggtcaattgaaccatacatatcttgagacacatcttctgcacgaagagtaattgagccaagcggaatcgtcacctccactttagccgttttttcacgatacaccttcaagttgactcgagcatccaactcttgttcagcttgaaaatacttttcgatcttttcgagtttagaaactacataatcacgaattgcttctgttacttctaggttttcaccacggatactatatttaatcatatgagtaccttctttctaaacatttttgtttttctgatttcattataacgctttcattttatttttgcaaattttttcctcatcttacaagggaaaatgtttttacatcctcagcacccgcttcttccaacagcttcttcacacgatttatagttgttccagtagtgtaaatatcatctataagtaggatttttttaggaatagtgactccacttttaataaagaaaggaaattctgtctccaaacgctctgagcgacttttagaagaactagctcgctcttctctcttttctaataaatccagatacgcaaaccctgctgcttcaactaaaccttcaacctggttaaatcccctctcgagcaatctttcaggacttaggggaattacaacaaattgatactctttgtacttttttaactcctcacttaaaactgaagcaaaaacttttcttaaaaggaagtctccatcaaacttataccgactgaaaaaatccttcatagcttgattgtaaataaaaatcgctctatgactgacctcaactccttctttacaccaaagttgacagtcttgacacttcattgacaaatctgttttcatacagtttgggcagttctcttctccaatcctctcaaaagtagaatcacaatctaaacaaagacaggaggcatcattcttcagaagtaaaagactactgaaagttaaaacagccttcatagtctgcccacataataaacacttcatagacccgcctccttattcatctgttgaatttccttaattgcctttttgattgaagtatttaacccgtcatggaagaaaagcaaatctcctgtcggtctgtccatactccgaccgacacgtcctccaatctgtattaaactagacttggtaaacagacgatgattggcctctactacgaaaacgtcaacacaagggaaggtaactccacgctccaatatcgtcgtactgataagtattgtcagttctctatctcgaaaagcttgtacctgctctaatcgattttctgtgatagaagatacaaagccaattttctcatttggaaattgctcctgtatgatttcttttaactgttcccctttcttaatctctgaagcaaaaatgagtaacggataacctgtctttctctgcttctcaatataagactttagctttggtgacaaccgacttttctctaaacagtgattaaaatcggataaccagacaggtttaggaataatcaaaggatttccatgaaatcgtcttggcaaactcaatcgttttaattctccgatgcgaaccttcctatctaactcatcggtagaagttgctgttaaaaagattctcaagccattctcctttacactattcttgacagcatggtaaagcataggattgtcaacataaggaaaggcatctacttcatccactatcagtaaatcaaaagcttgataaaacttcaataactgatgggtcgtcgcaacaactagtggtgttcgaaaatacggctctgattctccatgtaggagggctatctcacaagcaaaatccttttgcaggcgcttatacagctccaaacaaacgtctatgcgaggactggccaaacacactgcaccacccgcattgatcactttagctactacttgataaatcatttctgtctttccagctcctgttacagcgtgaaccaagcttggctcttgcttgtctaccgcttgaagcagtccctgtgataccttatcttgaaaaggggttaattgaccacgccatttaagaacatcttgcttcggaaaatcctcctgtgggaaatagtataaagattgatcactcctgactcgcttcatcagtaaacactccctacaatagtaagtaccgatgggcaaataccattcttctagaatagtactattacaacgttgacagaaaagtttccctttctcctttctcattgctggaagtttctccgccaactgacgttcctcttctgttaattcattctcagtaaacaagcgaccgagataatttggatttactttcatacttctttattcgtaaaaacctagcgctttaaatgattttttagtacaattaaatcatggaatttagaacaattaaagaggacggacaagtccaagaagaaatcaaaaaatcccgctttatctgtcatgccaagcgtgtttatagcgaagaagaggctcgtgacttcattactgccatcaagaaagagcactacaaagctactcataactgctctgccttcattattggggaacgtagtggaatcaaacggacaagtgatgatggtgagcccagtgggactgctggcgttcccatgcttggggtactagaaaatcacaatcttactaatgtctgtgtggtagtgacacgctactttggtggcattaaactaggcgctggaggattgattcgtgcttacgctggcagtgttgccttagctgtcaaagaaattggcatcattgaaataaaggaacaggctggcattgctattcaaatgtcttacgctcagtaccaagagtacagtaacttccttaaggaatataatctcatggaactggatacaaactttacagatcaagtcgatacgatgatttatgttgataaagaagaaaaagaaactattaaagctgcacttgtagagttttttaatggaaaagtcactttaactgatcaaggtttacgagaagttgaagttcctgtaaacttagtgtaaacaaaggagaaaaatatggcatttggtaaattcattcaaggactcgctggtaactttagcgagcaaaacaaagaaactcttatcaaagaatatggacaatatctactagaaaatgaagaaattcaaagtggatataaactgattcgtgattcaattatatttacaaatatccgtattatctttacagataaacaaggcgctactggtcgtaagatgtctattaaatcaatctttttgatgaacattgttaacgttgaaatggaaactgcaggagcaggtatagatgatagtgaaattactattacttatttagaaaatgtctttctaaaagcacacaatgagcattttaatgctcataaatttgaattccctaagaaaacggatatcattccactttacacctatttattagaattagcttatcacaatcgcttgaaaattaacggcttagacctgtgatataaaaaaatcctatcacttcgataggatttctatattttacaaatggtatagatagcgttatactagaaatatcttatacaaagaggtattcatatgtctatttataacaacattactgaattaatcggtcaaactccgattgttaaactcaacaacatcgtgccagaaggggctgcggacgtctatgtaaagcttgaagcattcaaccctggttcttctgtaaaagatcgtattgctcttagcatgattgaaaaagctgaacaagacggtattctgaaaccaggttctacaattgttgaagcaacaagtggaaacactggtattggactttcatgggtaggtgctgctaaagggtataaagtcgtcatcgttatgcctgaaactatgagtgtagaacgacgtaagattatccaagcttatggtgctgaactcgtcctaactcctggtagtgagggaatgaaaggcgctattgctaaagctcaagaaatcgctgctgaacgtgatggtttccttcctcttcaatttgacaatccagctaatccagaagtacacgaaagaacaacaggagctgaaatactagctgctttcggtaaagatggactagatgcctttgttgctggagtgggtaccggtggaacgatttctggtgtttctcatgcactcaaatcagcaaattctaacattcaagtttttgcagtagaggcagacgaatctgctattctatctggtgaaaaacctggaccacacaaaattcaaggtatctcagctggatttattcctgatacacttgatacaaatgcctatgatggtattgttcgtgtaacatcagacgatgcactagcactcggccgtgagattggtggaaaagaaggattccttgttggtatttcttcagctgcagctatctacggagccatcgaggttgccaagaaattaggtacaggtaaaaaagttcttgctctagcaccagataacggtgaacgttatctctctacagcactctatgaatttgaagtgtagtctcctaaatacacttagcccttattatagggctttttatttataccttaaaaataggaacatctccctataaaaatcgactgcatagaaaaaaggaagcaatttggcttcctttttattattagttattcaaggctgctgccattgtagctgcaacttcagcttcaaagtcgtttgcagctttctcgataccttcaccaacttcaaagcgagcgaactcaactactgaagcgttaactgattcaaggtatgcttcaactgtcttgctgtcatccatgatgtatacttgtgcaagaagtgtgtaagcttggtcaactttagtgttgtcaagcatgaagcgatccattttacctgggatgattttgtcccagattttttctggtttaccttctgcagccaactcagctttgatgtcagcttcagcttgagcaatcacttcatcagtcaattgagattttgatccatacttcaagtgtggaagagctggtttgttaaccattgcacggctttcattgtcttggtcgattacgtggttcaattgcgccaactcatctttaacgaattgctcatccaattctttgtaagaaagaactgttggtttcatcgctgcgatgtgcattgacaattgtttagcaagtgcttcgtctccaccttcaacaactgaaataacacctatacgtccaccgttatgttggtaagctccaaagtgttgtgcgtctgttttttcaatcaatgcgaagcgacggaatgagattttttctccgatagttgctgttgcagatacgtatgcagcttcaagagtttcacctgaaggcattgtcaaagcaagtgcttcttcattattaacaggttttccttcagcaataactttagctgtagtatttaccaattcaacgaattgagcgtttttcgcaacgaagtcagtttcagcgtttacttcaataactgctgcaacattaccgttaacataaacaccagtcaaaccttctgcagcaacacggtcagccttcttagctgccttagccatacctttttcacgaagcaattcaatcgctttttcgatgtcaccgtctgtttctacaagcgcttttttagcgtccataactccggcaccagatttttcacgcaactcttttacaagtttagctgtaatttctgccattttgattctcctatattttttaaaaataggagagccgggctaagccccgccctcctaggtaattactatttatatgaattaagcgttgtcgccttctacaacttcaacgatttcttcgattgaatctgcttgagcttctgaagctgcaaattctgcttcaactgctgctgcatcttcaccttgacgtccttcgatgatagcgtcagccaatttagctgtgatcaatttaacagcgcggatagcatcatcgttagctgggatgattacatcgatatcatctggatcagtatttgtgtcaaccatcgctacaactgggattcccaattttttagcttctttaacagcgatttgctctttgtgtgggtcaactacgtacatcacatctgggatacgaggcatatcttcgataccacccaagaatttttcaagacgtgcacgttgtttgttaagaagtgcaacttctttcttaggaagaacttcgaaagttccatcttcttccatacgtttgatttctttcaaacgagcgatacgtttttggattgttccccagtttgtaagagttccacccaaccaacggtggttgatgaagtattgacctgaacgtactgcttcttcagcaactgcatcagctgcttgtttcttagtaccaacaaacaatacaactgcatcgttagctgctgcatcacgcatgaaatcgtaagcttggtcagcgtattttacagtttgttgcaagtcgataacgtggattccgttacgctcagtgaagatgtacttagccatcttagggttccagcgacgagtttggtgaccaaagtgtacaccagcctcaagaagttgtttcattgaaattactgccatgagtatttctcctttttgtttttttcctcttcttgacttcaactcgcaaaacgacccaaaggcaactgtttcacaattcatcaagaatgagtattatcgttcacacgacaagtttcattttaccatactttttcaatattttcaagtgattttagcagatttttaaagtaaggtaactatatgaatcataaaagagactcaaatcgagcctcttcgttttattcattagtttggatagatatatgttacaaaaccttctgaagtcgtagtaggattgaaccatccacgtttatttccgattgtacggtttccaccatagtttgattcagatacttggatacttgttgatgatgaaacagctgtaaccacggctacgtgtccatatccaccatcattccaacatgcaatggcaccaacttgaggtgtagatcctgtacggaatcctgctgcagctgcacttgtagcccactgtgctccattaccccagtaatctccagcccaaggcgccaatgttttagctccccatgtacactcaccagttggataacttgaagcatttgtactatatgttggacgatgtgtcactggagcaggagtgtagcttgttgattctgttgaagcactgcttgaagatgattcagacgaacttgactcagatgaacttgatgaagaaatagtagatagtgcttgaacttgtgctgtaaaagttgtatttccagaagcaactactgtttgttgttgacttgcttgtttagctttataagctgcttctgcttctgctgcagctttagcttctgcttctgctgcagcttttttctcaagtaaacttgctttttcatcctctgcagtagccttttcagcagcaagattcaattctgcagctttcaactcagcttgttttgtagttaatgattgagcatcatcagctagtttttgctgatttgcaataactgtattaattgcatcattgtttgctacttgtttttcagaaatagcttttttatctgctttttgttgttccaacatcttgttgtttgcagatacgatttcactcattgcagcaacacgtgaaatagcttctgtaattgattttgagtttacaattgtattgatgtaatttgttgcagctccatttgtttgagcactacgagcttgtttttgcaatgaatcattgcgagatacaatattcttagaaagttctgtaatttcaccctcaagctttttagattctgcttgtagtctatcattttcagattgcaagtttgattgctctgtttgaatagcagacacttgctcctgaacttgatcaacttgtttttgggcttcttgttgttgtgctgttaagttactgattttattatcttgagcagcaattttgtcatcagtagtttctgcatgcgcagttgttaaaacagctacttgagaaaccattactgtacttaataaaagtgacgctaagatttttttcttcatattacgtagatactccttcttttaaagacattactagtataccaaaaaaaggcttaatgaatattacgcctttgttacatttttatttctttcttataggtaaaatttttcaaaaataaactgaaagataatcatccatataaggttcaaaatcattgatggtactaaactatagactataaataaagacatactatccacagttaaacctaccactaatgcaagtatataagctcccatctcaaatagaaaagtcatgacaataattgccaacattctcgtccaacgattcaataaaataacactattaaatttatggagaaatactcccaacaagacgaacaacaaagtcgcaatccctatcaagtggaaaaagtaaatgtcataaaccaaacccactacaaaacaataagctaaatagagatactctgatacttctatcgtctcaaataagagaaataaaaacagaaaatgactagccaaatgtacatgggggaaaaatgagcccagaagctggctaatatgggcgtcaattagaacaaagaaaggaagcaataaaaacactccaacccgcttcaactgtctcattatgaattccccactaattctatcacatccacattatgagtatctgcacttaatttaacagttacttctcgtgtcaagtagtccgtactatgcgttgtggcaaccacttcaccaacaggaatatcagcaacgttaaagtttcctaatccaccagtggtcaccttatctcctgcactaatatcgctactactatttaattgactaatttttagaacttcattttccttgtcatagccaacaataattccataaattgtagtagaaccatgttgaattttaacagaaatcttatcagcattttccgtatttgtcagaaggttgaccatggtagagttctcctctacttttgagacactcccaatcaagccaccatttgcaattgctaacatattctcagaagccccttttgatttgcctgcatctaaggtcaactcctgcttccaagataccggagatcgcataataacatctgctgccaaagtctttgtagcttgcaatttggacttcatatcaagcaattggcgcagttgttcattttccatctttaaactttccgcctcatttgatttaacttctaattggtaaatctgtttcttcaaactttcattttcattataagtgcgtgtcaaatgagccaaatctgatttgacagaatcaaaccactgaaaaggtttttgcacaaccctatcaaccactgagattccatctcctaatcttgtcacaattgtacttgaataagtcgtcgctaagagagctgacacaagcagaacagtgacaaaaacaataatgacatattttgattttttaaaacggttcatatccctacctttatatcaaaaactgttacagtaactttttatcaattcctgaaagctactaagattttaagaaaaataagcaacaaccaagtatgataataacaagaatggtcagcgtatcctttcgagtccatttcaattgtcgatattgacttctgccttttccaccctgataaccacgcgcttccattgcgatagccaaggaatccgcacgttttaaacttgtcgcaaaaagaggaatcaaaatgggaatcatagccttcaccttttgaacaatacttccttctccaaaatccactccacgcgctttctgtgcattcataatccgcgtcgtatcatccatcaaggttgggacaaaacgcaaactcatagacagcatcaatccaatttcatgaactggaactttcatactctttaaaggtgctaatagagcttcgacagctgatgccaaacttaagggcatggtcgttaaggttaacaaagtagaaaagaaaataatcaatacaaagcgacaaaagataattccagcttgttgcaaagcataatccgtgattctcacaaacgaaaactcaaataaaacattcccattagaaatgaaaaacagttgaaaaatagttgtgaaggcaatcaagaaaaacatagacttcaagccctgaataaaaaatgaaagagatactcctgacaaggcaataaagatccctgtcgctataaaaagaatcagattcgtcaagggattattagcccaaaaaacgatcaaaatcagtagcatcatagccagtaatttgctgcgtggatccaatcggtgaactatcgaatcccctgggatataacgccccaaaatcatactatccatttagcgactccttgaactcctctatcttaatcggtaatcgtttaaatgacacgcctctatcagccaatcgtttacaaaaagctgtaattttaggtactcccaactgaacttcttccataaaaacaacatcttgaaagacatcactaggtttaccaaacttaactaaacgtcccttttccatcacatatacctggttcgcatattcagcaacatcatccatcaaatgcgttaccaagacaatggtcatccctgactggtggagttttttgaacaaattcatcagctcttttcttcccaggggatctaggcctgctgtgggttcatctaagactaatatagctggttccatggcaagtatgcctgcaatggcgacacgtctcatttgtccacctgatagctcaaacggactacgatcaaaaagtgattcatcaattccaaccagagccagtttctcacgcgcaatctgctccgcatcttcttcagaaactccaaaattttgcggtccaaaagcaacatccttcaaaaccgtttcttcaaaaatctgattttcagcaaactgaaataccaagccaacctgttttctaatttgacgaatatctttatttttagaagtcgaggtgattaaggtatcaaaaacccgcacactcccttggcttggcaccaataaaccatctaatagttgtaaaatagttgatttaccactacctgtgtggccaattaaggccgtataagaaccatcttcaatcgtcaaagaaacatctgacaaagctgttgacgctaagggagtcccttcttgatacgtaaaactcacattttctagagcaattcccatagcttatcttctagctcactttctgtcaaataattttcaggcaaatcatagccattctggctcaaagaatgttttaattgattagcaaaaggatcgtctaatccaatttgatccaaatcatttcgagagaaaagctcccttggactactagttgattcaattgacccttttttcatgatcaacacacgatcactcatggcaacttcttccaaatcatgtgtaatggaaatgaccgtcatatcatagtctttccgaattccttttactgtctcaatcagttctctacgtccctcaggatccaacatactcgttgcttcatctaagattaaaatagctggtcttagggctacaacacctgcaatagccacacgttgcttttggccacctgatagacgcgctggctctctctttttaaagtccaacatgccaaccaaatccagagcttcttccactctctttttcatttcttgacgagaaagtccctgattttccaaaccaaaggcaacatcatcttcaacagtcgctccaacaaattgattgtctggattttgaaaaaccataccgatttgacgacgtatattccaaacattttcctcagtcagccgttggccatcaattacaatctctccggattctgcttccagtaagccatcaattaagcgaaccgtcgttgatttaccactaccattatgccctacaatcgaaagccattctccacgtttcacgtgaaacgtaatatccttcacatcgtaatattcctgactttccttatagcgaaaagaaagattttttacatcaattactgatttcatttcgaaccaaatgtccctttaaatacataggcactacccttgaaataatcatagccagagtagatagtgaaaaacaaggctacataaagtagaacttgaccaagcaaagtccaatgtaatagcaagaaaataatggcaaacatctgactaaaagttttaatttttccaggcattgctgctgctaaaactgttccaccagtttcaactaataaaagtcttaaacctgtcacagccaactcacgacagataatcactgcaacaatccaagctggagccattcctaactcaatcagcataataaaagccgacataactagtagcttatccgccataggatctgcaaatttaccaaaattactaaccacattccatttacgagctaaatatccatctaaatagtctgtaatactggcaatagtaaagataatagctgctaccatatgactctctatcgaatttcctactgttaaaataaagataaaaataggtataaagagaattcgacctattgttaagatatttggaatttgttcttttttcattcgtttttccttaatttttagtaaaggttacagcgatttttccagtctgagctgttaatttcgataaatcaacagtctgattgtctactgttaaggcaacacctttgacaacacctaaagtaattgtcacaggatttttagttgaaacgcttgtttccgcacttttattatccgatgataaagtcacaccaccctcaagatcactttctgaaacactaacccaacttctagcatctgacactgataattgcaattttgcagtttccttgctcgttttataagcaacttctactcgatttccttcacctgatacacttatagcaggttctatatttgaagaactactagatgagctactgcttgaagatggagttacagaactagtcgaacttattgcttggactacactataactagacgcagacgaacgctccggttgagtctggagataattccaaacataataagtcacaaaaatgacaatcgatagtgcaaaaagtataaaataaaataaaggtaaaaatgatgccttatttttcttacttgaacgtctcctacctgtcaactcgtcttcatcaacatctacttcctcataagtaatcatgctcccagaatcataagcatccaagacaattcgctcatcaagttcaactgcccacgcatactttctcaaaaaagaacgagtataaaatggactaggaagttgatcaaaatcatcagcttccattgcctccaacatatccaactgaatttctgtttttttatgtaattcttctaaagtcaacccttggttagttctagctaaacgtaaaacctcaccaattgtttttttcctcatacttgtcattccttctttctagtgtcgattatgataggttgctatgatggaaatattgtaaaatcaactatgtcaccatcatctattaaatggtgtccagcatcaaggacatcctctaaagtaatttcctgtaaaatctttggcaaatcaaagattgtctcaccttgtccaaaagcatcatattgcgttgcaataaattcaagagagttcatgctactgaaaaattctccaaacatctctctttttataatatctaaatgatcctctgtaatatctaaatcctttgtaaaattacgaatagcctttttaaactgatgagataaagcaactggctcttttgtatccattgtcaacataacaaaatgaaagcgacttgttacttcaacttcaagagataaggacgcatcaattttacctgattcatataacttttgaaaacgatccgaagtccaaccaaacatcattgcaaacaataattttaataaaatatgatgtcgatagcaatcatcctcagcaacatcttgtttacctctaacaccaatcgctagtttaggagaagatacttccattctcatactgtctgtttgctttacatcttttaaaacaaacttttctcttgctacttcctgaacatctaactcttccagttcttttctttcaaaatagtcctgtacttgatccacatcaaaattgccaactaaaaacagagacatgtttacaggtttgtaaaaccttgtgaaattttcttgcaaattagttagattaatttgggaaatggactcctcacttccaactatatcagttgctaaaggtgtaccaggatacaaattcgctaaagttgaaaagaataaacacgaatctggatcatcttgatacatttctcgttcttgctgaataatatcctgctctcttaaaatggaatcttcagtaaaatgtgctgatgtcaccaattcatcaagtaaatctacattctctaagagataatccgttgctgaaaaaagatagtttgtttttgtaaagcttgtaaaggcattgctatccgcacctagactcgtaaaagctgacatcaaatcgctagcatcttctctctcaaataatttatgttcaagaaaatgagcaattcctccaggatattcttttacatctccgtcaacttctgtgacaagcgtatctaccgaaccaaattgtacagttacactcccgtaaacctctttaaattcctttttaggcaaaagagcaactgtcaatccatttgacaaacgagttcgataaaccatttcttttacagctggatagtatttttcttcaaaaacaacctttgtcattctattccttccataaagtaaatcgcctgtagtttcacattattagctgctctacaaatatcatctttgtcaacttgctcgagttttgcaatccaacctttaaagtctgctgaagatttcccaagtaaagaattttgataagcacgttcaatcaatgaaccttgattatcttgagaaagtaacaaagatcgacgaatcatttccttggtctgctctaattcaagctctgtaaaatatcctttttttaaatcaagcagttgattattcatcattttacgagcctggttccgattttctcgatcgataccagcatacatcctcaagaacccactaaataaatcaagctgacttgaaatagtataagccaatccagcattttcacggacatttgtaaatagtttagagtgagcaaatccacccagtaaaccattcattacaatcatggataaatgttgctcatcaccatattcaacaggacaatgataacctaattccaaaatggattgtcccacatttttccgaaccataccttcctgaaggatattggaataaggttgacaatactgaaccttcacatctccttttcgacctttaaagccaaatgattctaatacattttgaatttcaacctcattaaaatcacctaggaaaaagaaatctattcgatcattggccaaaaattctttgaaacaagaataagaactttgtggagtttcagctaaaatacgatttcgtaaatcactgtattccaattggagacgttcatcatgaaaaaataatttatctaattctttatgtgcaaaataaaaagaatcatccatatcagctgctaaacttgctagcaattgttttttctcaatttcaaataaggccgaatcaaacccattatcaactacgacgggggaaaaaagagtttcttttactagttccaaaacctgagaagttagcacatttttcctacttaaaaactcatcacgaacataggtaaatgtcaattctacaatatgactttgccctcttctaaaacaattggttgacatatctgtaccatatagactggccaagtgtcttctcaaagcttgagaagtggggtacatctggttggacgtttctagcatactcgcactcaacatgcgacctgtaatcgtatcaagagataatggagaggtaaaacgcacggtaattttgttcgttttaaacttctttgattggataaaatgtgttgaaattccatgcactaactccatgatttacctcctcatatacagacttctattatatcacgaaaacctgaaattttcttgttccctgtaacacttttgaaataaaaatcgcttacatttctccctgtttctctcactatttttaggaaaatatggtataataccaaagattgaggtgaattatggaatacaaattatttgaagaatttattaccctccaagcactactcaaagaacttggaattacacatagcggaggagctatcaaatcatttctctctgaacattctgtttactttaatggggaattagagagtcgtcgtggtaaaaaacttcgcattggtgataaaattgacatacctgacatgaatattgacatcttattgacacaacctacttctgaggagcaagaggaatatcaagctgataaagttgaaaaagaacggatcgctaaacttgtcaaagagatgaataagggatttaaaagagacaaatcgaaacctacttcatcacctaaaagcaaacaagctccacgattccctggtagataatcatgtggctacaacacctatctctcaaaacttttcgtaactacaaagagacgaaaatagactttaatcctaaattaaatatctttttaggacgcaatgctcaaggaaaaacaaatatactagaggctatctattttttagccttaactcgtagtcatcgaactcgaacagataaaaatctcattcattttgatgaggaacaacttcatctttcaggtctagttcagaaaaaaactggatccattcccctagaaatagaactaacacaaaaaggccgtgtgacaaaagttaatcatttaaaacaggcacgcctttcagattatgtaggacacatgaatgttgtcttatttgctcctgaagatttacaactaattaaaggagcaccttcagttcgacgaaaatttattgatatggagcttgggcaaattaagccaatctatttatcagatttaaccaattataaccatattcttaagcaaagaaatacctatttaaaatcagctcaaaaaatagatgaaaccttcctttcagtactagatgatcagctagtcgattatggatgtcgtgtaatgaatcaccgcttagattttataaaaaaactagagcattttggtcgtaagaaacattttgaactttctaatcagattgaagagttgtcaatatcctatcaatcttctgtaaagtcaactgaaaaagaagacttatcagaatctttcaaaattgctttagaaaaaagtaggtccagagatttatttaaaaagaatactggtgttgggcctcatcgagatgacatttctttttatataaatgggatggatgctagtttcggaagtcaaggccaacatcgtagtctcgtcctctcgataaaattagcagaaatcgaattaatggaaagtattactacagaatctccgatattattacttgacgatgtcatgagtgaacttgacaacactagacagttaaaattattagaaacgatttctcagtcaatccaaacctttataacaacaacaagcttagatcatcttcaaaatttgccagaaaatctaagtatcttcactattcaggatggtaaagttgctgtaaatgaaaattgacaacattgtaaaagaactcctgtttttactggagttcttttcattgtttttttacatagaataatttggtgcctcattagtaatttgtacatcatgaggatggctttctttcaaaccagcaccagacatttcaataaattgagcattatcgtgtagctctttaaggttcgctgcaccaaagtaacccataccagagcgaataccaccaatcatttgaaagacaatatcagctgccgctcctttataagcaacacgaccttcaattccttctggaacaagtttgtttgcttcattgacagaaccttggaagtaacgatcacttgaaccttttttcatagcagcgattgatcccataccacggtaagtcttgaacttacgtccttggaagatttcagtttcacctggagcttcatcagttccagcaaacattgatccaagcataactgcatttccacctgcagcaagggcttttacaatatctccagaatacttgattccaccgtcggcaatgatcgttttaccatattcacgcgcaacagctgcagcatcgtagatagctgttacttgcggaacaccaacaccagcaatcacacgagtagtacagatagaacctggtccaatcccaaccttgacaacgtctacacctgcttcataaagggcacgtgcaccctcagctgttgcaatatttccagcaatcaaagtacgatctgggaagtgagcacgaatctcagcaattttacgcaagacacctgcagaatgaccatgtgcagtatcaataacaatcgcatccgctcctgcctcaaaaagagcctctgcacgttcaaatgtatctgaagtaacacctactgcacctgcaactagtagacgaccaaactcatctttagcagcatttggaaactcaataactttttcaatatctttgatagtaatcaaaccagaaagacggccttcttcatctaccaacggaagtttttcaatacggtgttcttgaagaatgctttcagccgttgcaagatctgtacctacaggagcagtaacaagattttcactggtcatatgatttgagattggttggttatagtctgaaataaaacgaagatctcggtttgtcaaaataccaaccaatttacgattttcaagtgtttcaacaactggaacaccactgatgcgataacgacccataagctcatctgcttcagcaattgtatgttcaggcgtcaagaagaacggatcaataataactccattttcagaacgttttaccttacgaacctcgtctgcttgttgagcaattgacatgtttttatggataactccgagaccacctgcacgagcaatagcaatggccatttgactctctgtaactgtgtccatggcagcggtaataattgggatatttaaagtcaaattatctgccaatttagttgttaaatcagcatcgttaggcaacacatgactttcagctggaataagcaatacatcatcaaaggtaaaaccttttttcaaaaatttagtgtcccaattagacattcgaagtttcctcttttctttctttttgagcttgactctttttatattgtatctatcataccattctataaaaatttgtcaaatattacaggggtaaataaaaaactatcttttctttgagatagaaatgatagtttcttgtaaaataaacttagttaaagtaattgagtcccattgcacctttaacctcagatagggtttgacctgctacttcacgcgctctttcactacctttttgaagcatattataaacttctcccatatccttagcaaattcgatacggcgctcacgaataggaccaagttcacgctctaatatttcaagtagataacgcttggtcttcacatcaccaagaccacctcgttgataatgttctttcatgtcagcaatttcttgagcatcttctggacgaccaaaaacatctagataatggaaaaccatatttccttcaattttacctggatcctcaacgcggatatgatctggatctgtatacatactcatcacttttttacgcaaagtatccgcatcatcagctaaataaataccattattgagtgatttagacattttagcatttccatctaaaccaggcaaacgccctgctctctcattttctggataaataccttccggttctaccaagacatcacagttatatgcattgttaaaagaacgaacaatttcacgagtctgctcaatcattggtttctgatctgtcccaacaggaacatagttggccttaaaggctgtgatgtcagctgcttgtgcaattggataaaccaaaaatcctgtcggaatgctttctccaaattccttctgagcaatttctgtcttgacagttggattgcgctccaaacgtgctaatgacactaaattcatataatacatagacaactcagctaattctggaatttggctttgaataaagatagttgatttacttggatccaatccaactgcaaggtaatccaaagctacatttccgatagactctacaatggtttgagggtctttagcatgatctgtcaaagcttgttggtcagccaagaacacaaacatatcatacttatcctcttcctgtaataatactcgatttttgagacttccaacataatgtccaatatgcaattttcctgttggacggtctcctgttaaaataatgggtttagtcattttgttctccttcgatatagtcccttcaattatagcatttttttaatgaaataaccgtaatttatcaaaataaatcagccttgctatttacggatttgtgtaaagtatgctgtaaatttaatttacacaaaattgatagataaaaatttgaatatttccgtattttctagtagaataaatatattacatatataggagaaaaacattgcttacagtatctgatgtttcactacgttttagtgatcgcaaactttttgatgatgtcaatatcaaatttacagaaggaaatacttacggattgatcggtgctaatggtgccggaaaatcaacctttttaaaaattttagctggagatatcgaacctactactggtcacatctctcttggtccagatgaacgtctctctgttcttcgtcaaaatcactttgactatgaagatgaacgtgccattgatgttgttatcatgggaaatgaaaaactttatagcatcatgaaagagaaagatgccatctacatgaaggaagatttctcagacgaagatggagtgcgtgctgccgaacttgaaggagagtttgccgagcttgggggatgggaagcagaaagtgaagcctctcaactccttcaaaacctaaatatcccagaagaattgcactatcaaaatatgagcgaattggccaacggtgaaaaagtaaaggttctcctcgccaaagcactttttggtaaaccagatgtccttcttttggacgagccgaccaatggtttggatatccaatcaattacatggctagaagacttcttgattgattttgataacaccgttatcgtagtatcacacgaccgtcacttcttaaacaaagtatgtactcacatggccgaccttgacttcggaaaaatcaaactctatgtcggaaactatgacttctggaaggaatcttctgaactcgctgctaaattgctagcagaccgtaatgctaaagcagaagaaaaaattaaacaattgcaagaattcgttgctcgtttctctgctaatgcttctaaatcaaggcaagcaacatcacgtaagaaaatgcttgataagattgaacttgaagaaattgtaccatctagtcgtaaatatccatttatcaactttaaagcggaacgtgagattggtaatgatctcttgacagtagaaaatctaactgtaaagattgatggtgagactattttagataatatcagctttatcttgcgtccaggtgataagacagcgcttattggacaaaatgacatccaaacgactgcattaattcgtgcaatcatgggggacattgactatgaaggaactgtcaagtggggagtaactactagccgttcttacttgccaaaagataactcggcagattttgcaggaggagagtcaatccttgactggttgcgtcaattcgcaagtaaagaagaagatgacaatactttcctacgtggcttcctcggccgtatgctcttctctggagatgaggttaacaaacctgtaaatgtcttgtcagggggagaaaaagttcgtgtcatgctttcaaaactcatgctcttaaaatcaaatgtccttgtacttgatgatccaaccaatcacttggacttggaatctatctcaagcttgaatgatggattgaaaaactttaaagaatcaatcatctttgccagccatgaccacgagtttattcaaactctagccaaccatatcattgtcttgtctaaaaatggcgtcattgaccgtatcgatgaaacctatgatgaattcctagagaatgcagaagtacaagcaaaagttaaagaactttggaaagactaaaaaaattcaaaactcagttgggttaaccagctgagttttctaacattttatgaggtaacatgaaattattttttaaaacatattggacctattttgtttctttcatcattcccataatcattatgataggagtatatctatctcaaggtatctactggaatagcgatacatctccactattaggagatgggtttcatcaatacgttatttttgatatagctctaagaaatatcctacacggaaatggtagtttgttctacacctttacaagtggcctcggattgaatttctatgccctatctagttattacttgggtagtttcctttcaccactagtttacttttttgatctaactaatatgccagatgctgtctatctgacaactctcttaaaatttggattgattggactgtcaacttactttagtttaaataaattatttcaatcgattcctaatcctttaaaactagctttatctacttcctatgctctgatgagtttcactgtcagtcaattagagataaaaacctggctagatgtttttatcttgattcctttaattataactggtttacagatactcatcactaaaaagaaattcctattgtactttacaagtctgtcaatcttatttatccaaaactattattttggctatatgacagcattgtttcttattttctggtatctctgtcaaatttcttgggactttaaaacccgaaaatcatcttttcttgatttcataatcacctctgttttagctggtatggctagtttgattctgattcttcctactctgtttgatttacagacacatggggaaaaattgactgaagttacaaagtttcaaactgaaagtagctggtatcttgatctttttgctaagcaattcatcggttcctttgatacaacaaagtatggggccatcccaatgatttttgttggactacttccctttattttgaccattttattttttacgctgaaatctattaagtttcatgtgaaacttatctatgcaatcttctttacatttctaattgcaagcttttatattgaagttcttgatttattttggcaaggcatgcatactccaaacatgtttttacatcgctatgcttggattttctctaccttgttaatttacacagcagcggaagtcttaaatcgtctgaaagaaattaaaatctggaattttttagtttcgctttttcttatagtaacaggatttttagctaccatctatctaaaatcgcattattcttttttaacagatttgaatattctgcttactcttgaatttttggttgtctattcgcttttactccttgcagttatcaaaaagtttatctctgtaaatctatttgccattctaatctctttatttataatggttgaaatgagtttaaatgcttcatctcaaatggacggaattgctaaagaatggggttttgcttctcgaagttcatataatcgagatatcccagctatggaatctttctcaacagatattggaaatcaatttactcgtactgaaaaactacaaactcagacaggaaatgacagtatgaaattcaactacaatggaatctctcaattttcatctgttcgaaatcgttcagcaagctctactttggataaacttgggtttaaatcctctgggactaatctcaatctccgctatgcaaataatagtattttggctgatagtttatttggtatccagtacaatatctcagacaaccctattgataagtatggttttaaagatatctatcaaaaagataatcttgccctatatgaaaatcaattctctcttccgattgcatttgctagtcaatttgtttacaatgatgtcaagttcaatgaacatactttagataatcaagcctcgtttttaaatcaacttgctaacgtcgattttgattatttttctccaatcctttatgaaaaaaccgaaaatactgatgatttgattagtgttacaagttcttcaaatgaggatgcagcaatccagtatcaaattgaagtgccagaaaacagccaagtttatctttctttcacaaaccttcacttttctaatgataaacaaaagaaggttgacatccttgtaaatagtgaaaaaaagacttttacaactgataatgccttctccttctttaatctaggatatacaaaagagaaaaaaactttcaatatcaatgttagtttccctggaaattcacaagtatcatttgaatctcctaccttctatcgtttagatacccaaactttaactgaggctattcaaaaaatcaaagaacaacctgtaacagtatcaacttctaaaaacaaggtttttgctacatatgatgtccaacaagatacatctattttcttcaccattccttatgacaaaggttggtctgcctaccaagatggtaagaaaatagaaattaaacaagctcaaactggatttatgaaagttgacgttcccaaggggaaaggaactattacactttccttcattcccaatggttttattactggagcaatctgttcctttacttctctcttactatttggaatctataatcacagacaaaagtcatctaaggcataaaaaatcgaccagttggtcgatttttttaatcttcttccattttcttaggctgataggctagcatacctaaaccaataaatagtactagtatcacagaaaggaaaatgacttgatgatgaatatttcctgtcatagagattgtttctcgtaatccagaaactgaataactcattggtaaccaaggattaatggctctaaagaaatcatttgtcaaagcaagtgggtaagtacctgcacttgatgctaactgtaataaaagcaaaataagagaaaagaaagctcctatacggctattccatgttgttaaagcggtcaccatggacatgaatactaaacttgttaggataatgagaataaatgttctcatctcatgatttgcagttaaaccaataagatgaactcctccatataccaaaattcctgccaaaacagctataataccatttatttctgctcgagatttcaaccaagcccaacgactctccggatgacgtcctgaaggcagcttcgcaaagatcatatttgttgatattgctgcaacaaaaagagcaactgatatcatataaggagccattgcaactccatttacaggaacttgatcattgtctgttttggaaagactgagaggatttgataaaatctctgcatttttagattccgtagatgctgatttgagttgatcactggcattactcaatccttgtcctaaagaagcaactcctgtctgtaaaccttccaagccagaagttaactttgttccaccttctgctagtttcccagctccatttgccaatttattagctccactttctaattgagaagcacctgaaattaactgactggatttgtcagctagttggctagagcctgattgcaatttatcaactcctgctatcaattcttgactcttttgattcaattggttagagccagttgataatttttcaataccagacactaattctggagttttttcaactaattgaccaactcctgctgtcaagttagaagatttttgtgtcaaggtagttgagcctgaaactaattggtccaaactacctgtcaaggtggaattcttttcacttagttgacttgcgccttgagaaactttatcaacacctgcagtatatgcatttacacctgatgtaatagactgactggcaggaactaatttgctagcaacagctccttgtatctctgttaatccacttgacaattctgtcaaagaactagaagcgataggtaatacttgattagcttgattttttaaagtcgaaagattaaaagactgattttgtaagttttccaaacttccctgtaaaccttgagctaaagctacaattgactgagccgattgaatactatcagtcgaattttgagatacagaagcgcttatctcagcttgttgctcacttgtcaatgattgataagctgctgtcgattgaatattggctaatgtagtcgctttatcagactgaacacttgctaacatttgattagaaagagatactatacttgataaaacagaatctaattgttttgtatctccaacatcaatattttgaatagcttgatttaactgattcaaaccagaagataatttattaatttgatctttttgctcagacgaagtatctaacttgctagaaagttgttgaatcccttcacttaattgctccacacccattcgaagtgtagctgattgattagataactgattagcacctgttgcaagatttcccactccatttgtataggcactaacaccagatgaaaattgattaagaccagcattgagcttagaaacaccgccagtataagattctacaccagtatataattgattaattcccctcactaattcagggcttttagaagataattgacctaacccactatctaattgactcactgcaccagtatatgtaactaaaccactattaaaattccctaagccaagatgaagttgttcaacaccagagacataagaggataatcctttagtaaactgctccgttccatttgaaaatgttaaacttgaagctgctaaagagtttaggttaatagttaatgtttgacttcctgccactaactgattcgctccatcagttagtttttcacttccagaagctgcttgactcataccatcctttaaatcgaccattttgttgaataaagctttagtataggtctcggttacattggtagaaacactctgctttaattgtgtcattgcagaatcactcatcttgctggcaataaagctatgaccacttgaagtctgataatcgatttgcatttgctcagggtgatccgttaaaatagaagctgctttttcagacaagtcacttggcaaagtgactaccatataataatcaccgttttctagacccttcttaccttcttcttcatctacaaaatgaaaatccaatgatttattttgctctaaattagacaccatgtcttttcctatagacatgctattaccattataagaggcctctttatcattattgacaactgccacaggtaagtcagacacttgaccatatggatcccacattgaggataaaaatatgatattgtacagagcgggaataagagaaattcctatcatgacaataataaaggttggttttttaaaaattgctttccattctttaaacatagtttctccttttttaaacatattgtctaaaattttgatataatagattatacattaaaaaatctaaattacaagataaaaaatccatttttagacatatagtctaatttgtttacaaggaggaaatatgcaagaaagtaacaaacgcttaaaaacaaagcgaactattgaaaatgctatggtacaattactcatggaacagccatttgatcaaatttctactgtcaagctagcagaaaaagctggaattagtcgttccagcttctatactcactataaggataagtatgatatgattgagcactatcaaagcaagctatttcatacatttgaatatatttttcaaaaacatgctcatcacaaaagagatgctattctagaagtatttgaatatctagagtcagaaccacttctagctgcccttctttctgaaaatgggactaaagaaatccaaaatttcttaagaaataaacttcatatcatgctcagtacagatttacaaaaacgatttatacaactgaatctcaataccactgaattagaatacagtagcatctatctaactcacgcactttttggtgtttgccaaacttggattgcacatggaaaaaaagaaagtcctcaagaaataacagacttcctcatgaagatgcttggtgatacgaattgatgcaaaaaagggaacaacactgtgttcccttttatctatactccgccagtaggactcgaacctacgacatcatgattaacagtcatgcgctactaccaactgagctatggcggataaaatagtccgtacgggattcgaacccgtgttaccgccgtgaaaaggcggtgtcttaaccccttgaccaacggaccttctatctgtagcagatataaccattatatcaatttcttactaattgtcaatcacttttgagattttttctctagaatatcttttaattttctaatttttaatcttgaaataggacaacgatggtcttcatagaaaacaatttctaagttttttcgatcaatttctctgatattgcctatatttaccaaaaatgacttatgaggagaataaaatcgctgagtatgtttgtccttttcctgaatatctgtcatggtaccgtaaaactctttggcaaaattcttaccaataatgcgtaatttatgagagacacctgtcgtttcaatatacaaaatatcatggtaaggaatttttaaatcatttcccttgtaattgtagtcaaaataatctacaacatcttcattttcaagtaacatactcttcgtgtagaagatattttgctcaattctcttcttaaacaactcatcattgatatccttatcaacaaaatctaaggctgatacctggtatttataggttagagtcgcaaactctgatcgactggtgataaagacgataatagcgtaaggattgtgatgacgaataaactgagcaacttcaaacccttttttctcaattccatgaatatcaatatctagaaaataaagctggtttacttcatcattttcgatatattccttaaactcacgaacttttcccgttgtcttgtatgatattggaatattcgattctttcgaaatttcatccaatattctctctagtctcacttgatgttcaataacatcttctaaaattaaaactttcattcaaattccctcttaaacctaataatttgtctaaatgtactgccttccatctctgtttctaaaataatattgttgtatttatctagtagttctttcacattatttaagcctactccgcgatttcttcccttagtggagaatcctaaggcaaatagatctcctgaaggagtcatcgtcattttacatgaattctgaatcacaataactgtttcggtttccatcttaataactgctacttccatttgttttttatagctatcagctgatccttctacagcattgttcaataaaacactcatgatacgaaccaaatccaatagttcaattgggagcttggtaatcttatcttttacttccagtgtaaactctacaccattatttcgagcatagacaattgactgagcaaccaaacttcgtaaagctgaatcttctatgttgttcaagtcaaagtaagtatacttatctgaacgcagtttgtgatttgctttgaccaaaacttcattgtaaactctgtcaatttcctgtaaatcaccactatcaattgccatctgcatgctgacaagcatcccggcatagtcatgtcgaaaaccacggatttcattatacagtccgacaatttcatctgtataattctgtaaatgtttctgttcaaatttcttctgcttcaaagcaatctctttctccattttttctttatgcgaattcattgcaaaaaaggtcaaaagtaaagagataaagacaatagatgataaaatacttccaaaactattcaaatgtttaatcgtacttaccatatctgaaatgaaagatacaacatgtagaagtagtaaagcaaaaaagacttttttcaagaaaggatagagataatctttgtcaaaatagtttagttccaaatggaaataacgaatgattgttacgataacaacataagtcaacgccactacaactaaaaagaatagactatgatattgtagggcagtatcatctcctattatagaggataaagttacggatagaaaggtatgagtgctattatataaaagggatagtagtaaacttaagaatactcctctatacttctcatactttttaataaatctaaaatatgaatataataccaaaggaaataaaaatttttcaattcctaatccatctaagtatataaaataaaaggaaagttcaaatactgattctactaggaatgtataaccaccaaaaaagcatagttcttttatatttattttatttttacatattaaatagtaacttttactaataataaaaatatgtaatatcacaactaatactgcaagaaaatccattattccactcctttatcttcttttaaagaaattaaagaaaatattatgtgtttgccttatctccccaccttgaatattttgcaagtctttttccttcaattctacaaacttatctaaattaactgtgtttttcataataaaatctcctaaaatgtttttttcttgtaaactaacttacaaaaactattatacaaaatggaatttcgttttagataaaattctctcaactgtcatttttttctccccaagtgtacttttttaagaaaaaagccgggaaaattcccagctttgctactatattgatcccagcaggattcgaacctgcgaccgttcgcttagaaggcgaatgctctatccagctgagctatgagacctaatacagctattctaccaaaaattcaattgaaagtcaattttctatttatgatagggcgagccctgctgtattgtaaaagctcgatagatttgttcaacaaggactagtctcattaactgatggggcaaggttaaacgaccaaaactaacagagagattggctctcttttttacatcctgtgctagtcccagactccctccaataataaatgtaagagtagaaaatccttttatagaagcttcttctaattgtttactaaattcttctgaggagaaagttttcccttcgatagccaacacaatcacgaaatcacggtcaccaacttttgataaaattctctgaccttctatttctaaaatcttttgattttctgattcactggccttatctggtgttttttcatctgccagctctatcatttcaagcttagcaaatcgagaaattcgttttgaatactctgcaataccatcttttaaatacttttctttcagtttcccaactgttacaactttaattttcatgactctattctaacatattctctattttttcacatcttattcacaaaataaaaggttaattttagccgagaaaaccacagattttttaaagttatccacaatctgtgtaaaacttttgtgtttaagttataattaagctagtcagtttatactttcagtaattcaaaaatatggaggcaaatatgaaacatttaaaaacattttacaaaaaagggtttcaattattagtcgttatcgtcattagcttttttagtggagccttgggtagcttttcaataaaccaactaactcaaaaaagtactgaaagtacctctaacaacaatagtactattacacagactgcctataagaatgaaaattcaacaacacaggctgttaacaaagtaaaagatgccgttgtttctgttattacttattcagcaaacagacaaaatagcgtatttggtaatgatgatactgacacagattctcagcaaatctctagtgaaggatctggggttatttataaaaagaatgataaagaagcttacatcgtcaccaacaatcacgttataaatggtgccagcaaagtagatattcgtttgtcagatggaactaaagtacctggagaaatcgtcggagctgatactttctctgatattgctgtcgtcaaaatctcttcagaaaaagtgacaacagtagctgaatttggtgattctagcaagttaaccgtaggagaaactgctattgccatcggtagcccattaggttctgaatatgctaatactgtcactcaaggtatcgtatctagtcttaatcgaaatgtatctttaaaatctgaagatggacaagccatttctacaaaagccatccaaactgatactgctattaacccaggtaactctggtggcccactaatcaatattcaaggacaggttatcggaattacctcaagtaaaattgccacaaatggaggaacatctgtagaaggtcttggttttgcaatccctgcaaatgatgctatcaatattattgaacagttggaaaagaacggaaaagttactcgtccagctttgggaattcaaatggtcaatctctcaaatattaatacaagtgatattagaagactgaatattccaagcaatgtaacatctggtgtagttgttcgttctgtgcaaagtaatatgcctgccaatggtcaccttgaaaaatacgatgttattacaaaagtagatgacaaggaaattgcttcatcaacagacttacaaagtgctctttacaatcattctatcggagataccattaaaataacttactatcgtaacggtaaagaagaaactacatctattaaacttgacaagagttcaggtgatttagaatcttaattgacatctatgtaaagaaagctttacataagataaaagatgtgttagtgtagaatcatggaaaaatttgaaatgatttctatcacagatatacagaaaaatccctatcaacctcgaaaagaatttgatggagaaaaactacatgaactagcacagtctatcaaagaaaatggggtcattcaaccgattattgttcgtcaatctcctgttattggttatgaaatccttgcaggagagagacgctatcgggcttcacttttagctggtctaaggtatatcccagctgttgttaaacagctttcagatcaagagatgatggtccagtccatcattgaaaatttgcaaagagaaaatttaaatccaatagaagaagcacgcgcctatgaatctcttgtagagaaaggatttacccatgctgaaattgcagataaaatgggcaagtctcgtccttatatcagcaactctattcgcttgctgtccttgccagaacagatcctttcagaagtagaaaatggccaactatcacaagcccatgcgcgttcgctagttgggttgaataaggaacaacaagactatttctttcaacgaattatagaagaagacatttctgtaaggaagttagaagctcttctgacagagaaaaaacaaaagaaactgcaaaaaaatgattatttcatacaaaatgaagaagaacagttaaaaaaaatactcggattagatgtagaaatcaaactgtctaaaaaagatagtggaaaaatcattattgctttctcaaaccaagaagaatacagtagaattatcaacagcctgaaataaggctgttcttttattt

SEQ ID NO: 73 - DNA, 2436 bp, Streptococcus mitis NCTC 12261 contig19
caaattttttctaaaaatagcttgacagattaaatttttaggagtaaactgtttaccagttaattaaatagttaaggggttatctatgaagaaaaaaagtttatttttagtattgttaagtatctttcttttgtgtttaggtgcttgtggtcaaaaggaaagccagtcaggtaaagggatgaaaattgtaactagtttttatcctatctatgctatggtcaaggaagtatctggtgatttgaatgatgttcgaatgattcagtcaagtagtggaattcactcctttgaaccttcggcaaatgacatcgcggccatctatgatgcagatgtctttgtttaccattcgcatacgcttgaatcttgggcaggaagtctggatcccaatctaaaaaaatctaaagtgaaggttttagaggcttcagagggaatgactttagaccgcgtcccagggctagaagatgtggaagcaggggatggagttgatgaaaaaacgctctatgatcctcatacttggctagatcctgaaaaagctggagaagaagcccaaattattgctgataaactttcagaggttgatagtgagcataaagagacttatcagaaaaatgcgcaagcctttatcaaaaaagctcaagaattgactaagaaattccagcctagatttgaaaaagcgagtcagaaaacctttgtaacacaacatacagccttttcttatctagcgaagcgatttggactcaatcaacttggaatcgctggtatctctcctgaacaggaaccaagtccaagacaactaacagaaattcaggaatttgttaagacctataaggttaagacgatttttacagaaagtaatgcttcttcaaaagtagctgaaactcttgtcaaatcaacaggtgtggggcttaaaactctgaatcctttagaggcagacccacaaaatgacaagacttatctcgaaaatcttgaagaaaatatgagtgttttagcagaagaattgaaatgaggaaagaatgaaaatcaataaaaaatatgtagcgggttcagtggcagttcttgccctaagtgtttgttcctatgaacttggtcgttaccaagctggtcaagttaagaaagattctaatcgagtagcttatatagatggtgatcaggctggtcaaaaagcagagaacttgacaccagatgaagtcagtaagagagagggaatcaacgccgaacaaattgttatcaagattacggatcaaggttatgtgacctctcatggagatcattatcattactataatggcaaggttccttttgacgctatcatcagtgaagaactgctgatgaaagatccgaattatcagttgaaggattcagacattgtcaatgaaatcaagggtggttatgtgattaaggtagacgggaaatactatgtttacctcaaggatgccgcccatgcggacaatattcgtacaaaagaagagattaaacgtcagaagcaggaacatagtagtaatcacgggggtgcttctaatgatcaggcagtagttgcagccagagctcaaggacgctatacaacggatgatggttatatctttaatgcctctgatatcattgaggatacgggtgatgcctatatcgttcctcatggcaatcacttccactatattccgaagagtgatttgtctgccagcgaattagctgctgcccaagccttcttatctggaaaaggtgatcaattaagtacagttgaatatcgttcaagcagagctgaaacaagatctagtgtgagaacaagtcaatatgagtctcctcaaaatcctgcagcagctcctgagagtcaaaatgaggatttggatagtctcctccaagaattgtacgctttgccacttagccaacgtcatgtggagtctgatggattagtatttgacccagcacagattacaaaacgtactgccaatggtgtggcagttcctcacggagatcatttccatttcattccttattcgcaaatgtctgctttggaagaaaaattggctcgaaatctaccaattggaggtcagccagttcaaagtcattctaataatacgaaaccaagcagtcctgagagaacaagttcaacaccaagttcaaccattaaaccaaactttaatctcaatacgccggcaccgaatcgaggaactggaggagcttatacaacggatgatgggtatgtctttagtccgacagatgtgattgaagatacaggtgacgcttttgttgtaccgcatggaaatcatttccactatattcctaagagtgatttgtcagcaggagaattggctgctgctcaagcctattggaatgggaagcagggctcacattctgccacaagctcaagtaaaccaagtagtgataatgctaaaccagcccaaccaagtttgacagagactccaaacctgactgtcacaccaa

SEQ ID NO: 74 - DNA, 8218 bp, Streptococcus mitis NCTC 12261 contig20
cgaatggcattgctttacgcaattctgcaccaactttttcaatttcaaggttagctgcttgttcacggtaagcagtcaattttggacgtccagctttatagtcatttacaaagtcatttgcaaatttaccattttggatatctgccaagacagccttcatattttcttttacttgttcagtgattacacgtggacctgatacatagtcaccgtattcagcagtgtttgaaatagattgacgcattttcttgaatccaccttcgtagatcaagtcaacgatcaatttcatttcgtgaagaacttcaaagtaagccaattctggggcgtagcctgcttctgtcaagacttcgaaaccagcttcgataagggcagtcaaaccaccgcaaagtacagcttgttcaccaaacaaatcttcttcagtttcttctttgtaagttgtttcaagaagacctacacgagctgctccaacacctttacaccagtccatagcaatgtttttcgcatttcctgttgcatcttggtaaactgcataaagagctggaacaccaaatccttcttcataagtacgacgtaccaagtgtcctggtcctttaggagcacacatgaagacatctacatctgcaggaactttgataaattcaaagtggatgttgaaaccatgggcaaacccaactgcatttccagcttccaagtttggagcgatttctgcttcgtacaattcttgttggatttcgtctggtgccaaaatcatgataacgtcagccaatttagttgcttctgctactgtgtaagtgtcaaatccatcttcttttgctttgtcaaaagatttacctggacgtacaccgatgatgacatcgcgacctgagtcacgcaagttttgagcatgcgcatgtccttgtgaaccataaccgataacggcgatttttttaccgtcaagtgctgctactttaacatctttttcgtattccatttgaactgccatagtttttctctcttttctattatttattgccttttaggctggtttaacaaatttaagttggattgttaatcgcgggtaaatccagttgcacccgtacgagcgatattgcgaataccgtatggtcgaatgactcgcaatagagcttcgctcttttcagcatttcctgtcatttgaatagtaatcgagcttggcgctacgtctaccaccgttgcacggaaaggttgaataattgctagaatctcagctcgcttctcagctggcgctgacatcttaaccaaaatcacctcgcgctccaagtgtggtttatctgtaatatctctaatgcgaatcacatcaatttgacgattaagctgtttgataatttgctccacctcatcatgagaagctacatcaataataatggtgatacgcgatacattcggatcttctgttgctccaacagagatactttcgatattaacctgacgacgagacaggacaccggtaaagcgattgaggactcctgatcgattttgtagttttgctgttaacattctacgcatggaacttcacccccaacatctcatgattgctcttaccagctggtaccattggtaacacctgttccttacgagaaatatctacctcgattagcatcggaacatcctcagtgatgacttcaagatcttgagccaaggtctcaggattgtcaaatttatagtttttaataccgtaagcttgtgccatcaattggaaatctggaagggtatcaaagactgactctgatgttctaccttcatagaaggattcctgccactggcggaccattccaagtgagtggttgttcagcataaccaccttgattggcaccttgtaaatattcaaaatagccaattcttggttggtcatttggaaaccaccatccccaacgaacaagactacttccttatctgggttagcaattttagcaccgattgctgctggaattccaaatcccatcgttcccaaaccacctgaagtcactaactgacgttcattttggtaaggatagtactgagctgtccacatttggtgttgaccaacgtctgttaccacaatggcatcaccattcgtcaactcaccgatgcgttcaataacggcctgaggttgaaccacacgttctttcttatcataagaacgaacacggttcttgtctttagtaactttctcaatccatttctcagtattgttatgaactgtcggttctgctagcaacatttgcaaggctttcttagcatctccaactacaggaatatccgcactgataatcttgccaatctcagctgggtcaatatcaatgtgagcaaccttagcattcttagcgaaggtcttaggattccccgtcaagcgatcatcgaaacgacaaccaatactaatcataaagtccgcttccgtcatggcaatattagctgcgaatgacccgtgcatgcctcccattccaaggaagagtggatgactcgttgcaatcgttccttgtcccaaaagactggttaccaccgggatttgatagcgttctgcaaattcatttaattctgcagctgcttcagcataactaatccccccaccagctaacaagactggttttttagccttggacaattgcttcaaaattttcttgatttgcatatcattcggctcaagagtcggttgatagcttggtaggttcacttctggtgaatagatgaagtcggtttctaaagcagatacgtctttaggtaggtcaatgacaactggccctggtcgacctgtagttgcgatatggacagcttccgtaatgattcgagggatatcagctgtctcccgaacttggtaattgtacttagtgattggcatggtaattcccacaatgtctgcctcctggaaggcatccttcccaatccctgctcgcgccacctgacctgtaaagaccaaaaggggaacactatcgctcatggcatccgcaatccctgtaatagcatttgttgctcccggtccgctagtgacgacggcaacacccaactttccagttgatttggcataaccttcagcttcatgcaaacaaccttgctcatggcgtcctagaatgtggcgaatgcctttaaaattatatatcgcatcatacaaaggcaagactgcaccaccaggataaccaaagatggtatcaattcctaaatcacgaagtgtttccaaaactaggtccgaccccgtcttaggagattctaaactgattttctccattgttcccctttctcttctcttaaaaataacttgttactatcataccattttttcaaaatttttcaagagaaaagaagaaattttctgaattttctattttaacgtttatttatgaatgttatttttgtttttattaaaaagataccgatttcatttactaaaaaagaaaaaagaactgatttctcagttcttcattaatcttattccacactaaataggtatgggtaaactggttgttggccttggtgaatctctacctcaacatcttcgaattcttctgcgatttcttgggcaatttcattggcaagttcttcgcttccgtcttcaccgacatagaaggttacgatttcactatcttcatccaacatatgtttcaaggtttcagtcaaggtttggtgaatgtcagggtttgacacgaggattttcccatccaccataccaagattatcgttttcatggatttctaaaccatcgattgttgtatcacgcacagctgttgtgacgcttccgctaacgacatcgctaagagcagcagtcatacgctcttggttttcttcgatggacttgcttgggtcaaaggcgagaagacttgtcaaaccttgtggcaaagtacgagcttccaccactactgctggttgctccaaaacttctgctgcagattgagcggccataaagatattcttgttgtttggcaggaagatgatgttacgagcgttgacctgttcaacagccttgataaagtcttctgttgaagggttcatagtttgaccgccctcgataacataatccacaccttgagaacggaagatatctgcgagacctttaccagccaccacagcaattaaagcatactctttttcttcagcaggcttgctaacttgagcagcttctttctcaacctgtgcttcgtgttggttacgcatattgtcaactttcaccttgaccaagctaccatatttgagaccctcttgcataacaagtcctggatcttctgtatggacatggactttgacaatttcatcatcattgacaacaaggagagagtctccaagcacattcaagtaattacggaattcatcgtagtcaaaatctttggcataggttgggccttgcttaagagctaccatgatttcagtacagtaaccaaaggtgatgtcctcagttgctacatgaccagctacagacttgtggtgctctgcattgatcatttcactcatgttagccggagtcgctacaaagtcctcagatgcaatatattcaccagtaagggctgaaaggaaaccttcatagataaagaccagtccttgaccacctgaatccacaacgccaacttctttcaatactggaagcatgtctggtgttttagctagagctgttttagcaccttccaaggctgcgcgcatgacttcaacagcatcatctgtttgctcagcttttttcttagcaccgatagcagccccacgagaaactgtcaaaatcgttccttcaactggcttcattactgccttataggcaacttccacacctgattggaaggcaagggccaagtcttgacctgttaactcgtctttatccttgatggcttgtgaaaatccacggaaaagctgagacgtaataactcctgagttcccacgcgctcccatcaaaagacctttggcaagaatgctcgctacctctccaactgtagaagctggcttgtctgcaacttctttagcaccattttcaatggtcattcccatatttgtcccggtatctccatctggaacggggaagacgtttaatgaattgacatattcagcttgcttattcaagcgagttgatgcagcttgcaccatttcttgaaataagctagtagtaatttttgacacggttattctcctacaactttgatattttgaatgtagacatttacagtctgagcagtaattccaagttggttttccaaactaaaacgaacacgctcttgaatgttttttgacacttcgctaatctttgttccgtagctcaacacggtatatacatcaactgcaatactgccatcttcggctgcctttacgacgacacctttggaataattttccttacctagaagggcttggaaattatctttgagggcatttttactagccataccgaccacaccaaaaatctcagttgctgctccacctacgacggttgcaatcacttcatctgttagttcgatttgaccatcttttgtattaatttttacagtcatcctttttacctcaactagttgatactctattttatcatatttcagcccaagtgtaaaagcagaatactgtatcagcggatatttactctatttttcaaatgattttatatctacagtaaaagaaaaaagaccctaaggtctccttacttttattattaaacgcgttcaactttacctgatttcaaagcacgagctgaagcccaaacttttttaggtttaccatcgataagaacagtaactttttgaaggtttggttttacggcacgttttgtttggttcatcgcgtgtgaacggttgtttcctgatacagtcttacgacctgtaaagtaacatactttagccatttgtgttttcctcctattagatctaatatagcggatgtgctagcaccacatactgtactatgttatcacactttcttcatttttgcaagggaattggaagatttttttatttaacgtagacaattcccaacttcccaaaggccacatctccacggataatcaaggttttgctggttggcgctagaggagtatctgccttggctacgccacagaaagtttctacctttaaatcaactccccaatgtttaggaacatagataactgcattcccaaaaccgacttccactttcagagttgcgctatctcctaaaatctctgcattgtcataatatatcttggcatttccaaaaccaacttctacttggtcgtctaccaattcttgattttgcttgtagaaagtcccagtcctaaaagcaacttccttatctgtaagaatggtctttttaccatcataccaccattttttcccattccaagttctgttagaatgagtgagtgcgctgacacctattacgattaaaatacttgcccagaacaatgactgattgggaattggtaaaatgccataaaagtggttagcaatcattaaggctactagaactgtaaaagaggctgaagttaagtgacgacgcaacaaagctccaactgattgataggcaaaaaatgcaataccaagcaagggccaaatttgcccaccgaatgaagggattccaaaatttccttgtaataatattaaagctgccaatactagcaacacaataccaaatgctttctttttcatcttcttacctcatgtttcttagattttcttttaggagggattggtaatgtcgtgagacatgaacctccttgtgggtctgataaaaggaaatggtgcccgttcctgaaaaggacttgtccaccgagtaaacctgacggatatttgcaatagtcgacttggatacccgactgaaataacggggcaggatagactccaactcatagagtttaagccgaacctcgtaggcatctttctgggtatgagcataaattttgctaccttccgtctcaaagaagagaatttctgataagtccagataatattcacctgttcccttgtaaaaaatcaacctaggagacttggattcttgcaagaggcgctgtaaatccgcaatctcatctgtcaaagccgctgccttgatgacaatttcagtttcctctaaattgctgtcaatttcgattcgtaacttcattccatctcctttctgactctactatatcaaaggaaaaataagaaaacaagagcaaaaaagcaagtggttactttagatccgtaagtggttgtaaggctaccttaacttacaggtcaacatagaaataaaatcacaccccacacaagaccacaaatatagccaaccactacatccttgggataatgcactccccctaagactcttactagaccgaggaaagctgacaagaccaacaagataacccctacagataaactagcatgtaagcaagccatggagataatggttgctgaaaagacatgacgactgggcattgactgaccaggactatctctgtcaagcaagggtttaatagtccattcctcataaggcctaggggcattgattttcttacgaagaaaggacaaaatcacaaaacctgacgctggaataaacaaatagatcccgacctgtttcccaagtccttgttggagataggtagttgctaacaaggttagataaatcataggcataactactgtcatgaaccgattgaaagttcttaacaagctcagaagaaagggcttatttccaatgttaccggcaatgtggtcataccattcttgataatttttcatatattttctcatcacttattcaaattttgcttatagggaagcacttgtcttctagtatagtgcagaaaaagaaggccgtcaagccttctttgggtttattcttctgcttcgtcttctgtaaattgactgttgtagaggtcagcgtagaaaccagcttgcgccatcagctcatcatgatttccttgctcgatgatattaccattcttcataacaagaatcaaatcagcatttcggatggtagacaagcggtgagcgatgacaaaggaagttcttccctccatcaaacgatccatggctttctgaatcaattcctctgtacgggtatcaacagaagaagtcgcctcatctaggattaggagcggtgcatctttcagcaaagcacgagcgatggtcaagagttgtttttgtccgacagacaaggtcactgtgtcgtccaagacggtatcgtaaccatctggtagagtcataataaagtggtgaatccctacagccttgctagcttcaatcacgcgctcatcactaatacctgtttggttataaatgagattgtctcggatagtgccttcaaagag

SEQ ID NO: 75 - DNA, 5961 bp, Streptococcus mitis NCTC 12261 contig21
tggaatttcctactattgcaatatggctagcccctactatctggatgaagaagcactgaagtatattgattacgatttggatgttaaaatttttacagatggagagaaacgtctcttggacgttgaggagtatgagcgtcacaaacgcaaaatgaattattccgatgacttggactatattttaaaagaacatgtcaaaattcttgttgattggattaacaatggacgaggtcctttctcagaagcctatgtaaacatttggtacaagcgctatgtagaactaaagaatcggtaaagttgtcaaactggggttaagaccccggtttttttattttaaaaacccagctttacagctggggtgatttctatatatctaatttcgtaacagtaaatttgatgtgggaatagtctttttcaacatccttatccagcaagaaagctgtagcatctttcttaacctgaaccaggtcaatattctgagcttgggctgcatagacacaaccacaataacattgacggtaaatgtcatactcttcacacatctctaccgaacgtttgtagccttgatttttcttgaaatcacttggaagatagtgggttgtataaattttttgcacatcgattccgatactattaatggtttgagaattcttatgaggactgatggtcaaggctgagccaaagtagtcaaagcccaagtccatagccacttgagctgtcttatccagtcggtagtcaaagcaaacctggcaacggtcgccaccttcaggctcttcttccaaacctcgaaccagtttacgatattcgttaggttcataaggagcttctaggtattgaacgctattgccagttcgctcattgaaatcactgacaaactttttagtcacataggcacgcttatggtattctgccttgggatggatattagaattggcaaaatagattgtcacatctgcatacttggtcaaatattcgagggtataggtactgcaaggggcacagcaaacgtgcatgagaatggttggccgttgctcatttttctcccatacttgtaccatcttctgcatgacacggtcataattaatcttctgattgaggttcatcttgctcagaatttcttctacatcgatcatgttcttctcctttttatagtcttattttatcatataagttaggagagctcaaatctatttagaagtgaatatcataaaaaggaggaatagccattccctccttttgtgttttttataagttgttttctatagaaagcttacatcatcccacccatcatacttggatccattgctggagctggggctgctggttctggtttattggctacgactgcttccgtagtcaaaatcaagctggctacagatgctgcattttgtagagctgaacgactcactttaactgggtcgataatcccttgatcaatcatgttaacccattcgccagttgctgcattgaagcctgtaccaacttcagcatttttcaaacgatcgataacgatagagccttcaaatcctgcattgtgggcgatttgacgaacaggttcttccaaagcacggagaacaatattgcgacccgttgcttcgtctcctgttaattccaaatcagctacggcagggataacatttacaagggctgttccaccacctgcaacgattccttcttcaacagctgcacgagtagcgttgagggcatcttcaatgcggagtttcatttctttcaactcagtttcagttgcagctccgaccttgatgactgctacaccacctgacaatttcgccaagcgttcttgcaatttttcacggtcaaattcagaagttgtggtttcgatttgagacttgataactgcaacacggtgagaaatcgcttcaggatttccagcaccttctacgataaccgtgctatctttgtccacagttactctcgctgcttgaccaagtgcttcaattgtagcatctttcaactcaagacctaggtcttctgtgataactgttccgcctgttaagatggcaatgtcttcaagcatggctttgcgacggtcaccaaaaccaggtgccttgactgctaccacgttgaaggttccacgaatcttgttcaaaacaagagttggaagagcttcgccatctacatcatccgcaataatcaagagtggacgattgctttggagaatactttctaggagtggcaagatttcttggatatttgaaatcttcttatcagtaatcaaaatgtatggattttcaagatcagctaccattttttcgctatctgtcaccatgtactgtgaaaggtaaccgcggtcaaactgcattccttcaacaacttcaagctctgtttccataccacgtgactcttcgatagtgatgactccatctttgccaactttttccatagcttcagagatgtattcaccgactttttcagaacgagaagagacggctgcaacttgagcgatagcttctttgttggcaacaggaatagcattgtttttcaaggcttcaactgctgcagcaactgctgtttcaatcccacgacgaatgccaattggattggcacctgcagtgacgtttttgattccttcacggacgatagcttgggtcaagactgttgcagtcgtagtcccgtcacctgcgatatcattggttttagaagctacttctgataccaatttggcacccatattttcaaaatggtcttccaattcgatttctttggcaatagtcacaccgtcattggtaatcaagggtgaaccgaatgacttttcaagaacgacattacggccttttggtcccaaggttactttaacagtgtctgcaaggatatcgacaccacggaccatagctgaacgggcatcagatgaaaatttaatttcttttgacatacttactttctccttctatttttcaatgatagccaagatgttagcttcgcctacgatgatgtacttttcatcgccatctttgacatcaagacctgcgtgtgcttcaaccaagacacggtctccagctttaacacttggagcaaccaagtcaccgttcaaggtacgaacaccttgtccagtagccacaacttgagctgttttggttttttcttgggctgaacctgcgaggacaaaacctccaacagtttgttctttttcttctacttttaagaccacacggtcccctaatggtttcaacatctgatttcctccataatgagatagatatcattagcactctttacacttgagtgctaattcatagttctattgtatcacttggtcagaaatagtcaagaaaaaagtctgactttctcaatataaaaagcctgagaccaactcagactttttaatgcttaaaatggcaattcttcctcttccaaaaccaaatccgccaaatcttgtcctgcattattttcacgcatggcacgttgagcacgactttccaagagttggaatcctgtcacaaggacttcagtcacatagttcatctgaccatttttctcaaaacgacgggtacgaagttctccatccacagagataagactacctttagttgcgtagctggccaagctttctgctagtttgccccatagaaccatattgacaaagtcagcttcgcgctccccattttggtctttgtaacgacggttcacagcgatagttgctcgcgctactgacttgtcattgttggttttgtgcaattctggtgtagacgtcaaacgcccaatcatgataactttattatacatattttttcctcctacttatctattcgcagaaaatcaaaaaagttacagaaatttgtaacttttcgaggaaattttttactttttatgaaccatgaaacctgtcgcctgttgattggccataatggtcatatctgtaatctgcacacgacgaggttgactggtcacatagactactgtgtctgcaatatcctgagcttgcaaggcttctattccttggtaaacggacgcagctctctctttatcaccatgaaaacgtaccgtagaaaaatctgtttcgacaattcccggttgaatagtcgtcaccttgatatccgttgcgatggtatcaattcgcagaccatctgaaaaggtcttaaccgctgccttggtagctgaataaactgctgcacccgcataggcataaattcctgcggttgagcccatattgatgatatgtccttgattggcttttaccattgctggcaagaaacagcgagtgactgccatcaaacctttgacattggtatccaacatggtcagcatatccaactcttcatagttttgatatggagccaagccaagagccaaacctgcgttattgaccagaatatcaatctgacctatcgtttctagaatatcagagcagacagtctttaccatggtcatatctgtgacatctagcgaaaaagtccaaactgtctgatttgggaaggcttctgcaaactccgacttaagggcttctagtctatctgtccgtcgacctgttaaaacgatattctcaccctgctccagataagcacgcgcaatcgcttcaccgattcctgatgtcgcccctgtaatcacaacattttttgtcatcttatttccttctagctggtctatcagatactgacaacttcctaggtagtccagtgtttagctggatcaaatggagttccaacaacttggtcttctgataattcaataataccacgcttttgcggagcatttggcaaggcaagttcacgagggctacacatcatgccaaaactcttttcgccacgaagctcacctgggaaaataagattgcctttgggcatcatagctccaggaagagccacaatggttttcaacccgacacgcgcattgggagcccctgcaacgatttgcactgtcttgtcacttgcgactgcaacttggcagatgttgaggtggtcactatctggatgggctaccatctcaacaatttcaccaacaacaaacttaggttccttgtcattaacaatttcttctgtaaagccttctgcctgtaattcttggttcaaacgagcgacttgctcatctgataaaaatacttgaccgcgctctgcgatttcaaagaaagttgaaacttcgaaaatattccacgccactgtttccccattatctttgagaaaaacacgggctaccttgcctttgcgctccacatccagtttggcatctccgctatttttcacgatgaccataaggacatcaccgacatattctttattatatgtaaaaatcattgtttcctttttctcctatttcagtcctgctaaaaagtcgttaatttgttgcttgcttttacggtcgcgattaacaaaacgaccaatttccttgtctttttctagaacaacaaggctaggaattccgtaaacatcccagagtttggctaaatccatgtactggtctcggtccacccgaataaaggtgaactctggattggtctcctcaatttctggcaaggcaggatagatataacggcaatcgccacaccagtccgccacaaaaagaaaaaccttcttgccatctttttctactaaagatgctaattcttctaaacttgctggttgtatcataagacttcctcctcatagactaggtcttcatgttcatagacaaaggtataatgacggccatcctcaaaaatgacgccaccaaccaagctctctagactgctttcatagacttgaacatagagggtcgcaatttcccccatgtctgaaaaatggtctcgcacaatcgctgtcaactcttcctgagtcttcctgagcttacggtcatctgcaacttttttcgtagcaagggcaaggcttccaatacctagcagagccaagcctgccatccacatttttttagctttcataccattcattttaacacaaaaaaggctttaggacaaatgaggaaacagaaaaaaagcaagtaaaaagccccttcctttaaggaaaaggactt

SEQ ID NO: 76 - DNA, 4520 bp, Streptococcus mitis NCTC 12261 contig22
tgtatccgcttctgcacggcttttaatgacacatttatttggaatcaattgaactttttcaccagctgcaaggtactcagttactgctgcgaatacagcttcaactgctgctgctgagtctttcttagtcaattctgtagcttctgctactttagcgatcaaatcttgtttgtttgccatgttaatgattcctccaattttatttctaattaacaaatataatcatatcctaaaatcccttttaggtcaagttaaaaacgctatttcttcccattttatttatttttttaggagttgtaacgtactaaaacagcccaagcattctcacccgtgtgagtttgaataatagagcccgtttccaaaactgaaataggcttttcaacataagcttgtaagctttctttcatctcttttgcccaatcagcactaccagaatatgaaattccaatctctgctacagaacgttcagagagcgatgttatcagttcatccaaccattttttaaaagttttagctccacgacctttaactattggctgcaattcatggtccttcatctgcatgacaacacgtatattgagaagtgagctcaacaatccagttacacgcccaattcgtccacctttaacaaggttttccaaagtcgaaacgccaatatagagttctgtgtggtttttaacctcttctacatgagataagatttcctccaactctttgccttcttgcgctaattttgcagcctcaacaacttggaatttcaaggcttggtcagtgaaggaactatcaataactgttacatcggcagtagataagctagcaccttgacgtgccgcttctacagtgccagaaagggcgtgagacatatgaatagcaagaatctggctaccatctttgcataggtcttcaaaaacttcagcaaagacacctacaggtggctgacttgtttttggaagattcttactttcttgcatcaactgaagaaatttaccttcttctttcaaatccgcatcagaataaacaacattatcaatcattacagataacggaacaacagtgatatctaattgttttactagttcaggttcaatagtaacagatgaatcggttacaatcttaatttttgtcatagtatcaatctttctattttaggattcagattggttttcttacttttaattatatcaaaaaaagattaaaaatcctaatggagtcattcaaattttccttaaaaatttgatataatctacttataagaaaagaggtccctatgattaaaaaaatttatcccattttaaccattttactaggtgctgctatctatgcttttggtctaacttattttgtagttcctcatcatctctttgagggaggggcgacaggtattaccctcatcaccttttatctttttaaaatccctgtttctctcatgaacctgctgattaatattccccttttcatcctagcttggaagatttttggagcaaagtccctctattctagtttactaggaaccttagccttgtccgcctggttggccttttttgaacgtattccccttcatattgatcttcaaggtgatttactaatcactgcccttatagctgggattctattgggaattggtcttggaattatctttaatgctggaggtacaactggtggtactgatattgtagctcgtattctcaacaagtacactcatatatcaatgggaaaactgctctttatcttagatttttgtattctcatgctcattctcctaatcttcaaagatttgagattggtttcctacacgctcttatttgattttatcgtttcgcgtgtcattgatttgattggcgaaggtggctatgcaggtaaaggatttatgattattacaaaacgtcctgaccaacttgctaaggcgattaatgatgacctaggtagaggcgttactttcatctcaggtcaaggctactatagtcaaaaagatttgaagattatctactgtattgtcggaagaaatgaaattgtgaaaatgaaggaaatgattcatcgaattgatcctcaagcttttataactattacagaagcccacgaaatccttggcgaaggatttacctttgaaaaagaataaaaagaggtcttgtaggaccccaaaagttagactacatcatctatcttttgggttacagacaacctcttttttgtttactcaatctcttaagaccaattccgagctacttcttcatcagcctttaactgatccactaattggacgactgagtcaaatttagtcatgtctcgaatacgatcaagccaataaaccataacgggtttcaccataaatatcttgattaaaatcaaaaatattgacttcaaaacgtgcttcttctccatcaaaggtcacattttttccaacactagccatagcacgatacttctgtctttgaatctcaacatcaacaacataaacaccatctgctggcatataagtacgatctaaaagcactaaattcgctgttggataaccaatagtacgaccacgagcattgccatgaaccaccatgcctctcgatggaagcggtgcccccaaaagttctcctgcttctttcacatttccatctaaaatagcttgacggatacgtgttgaactaatctttcctttctcatcttctacaggtggaacaataataacttctccatcaaagtaatcctttaagtcctctgccgtttttttgtcagaaccaaatgtataatcaaaacctgcaacaataattttagcattcatagccttaatataggttgcaaaaaattcttctgccgtgagactagcaaatttgctactaaaatcaaggagatacaattcttctacgccttcacgctttaattttctctcacgttcagcagggttcaaaatatgcaaaaataggtcaggatgataaggctctaaagcgatctttggagattcattaaaggtcataactacgataggcaataaatcctttctcgcagccttgttggcaacacgaaatagttcttgatgtcccttatgtataccatcaaaatagccgagtacaacgaccgaatcggatggtgtgccaatatctttttgattttttataggaatagtaataatcataaaataattatatcatagtgatagctatttctgaaccagaaaatctgaaatgtcgtttttttaagctgaagtgtagcattttagaagaattttgtttttgaaatcgtaatacagaacaagagattgacgtaagaatcttgaaatcagaaaaacgcatcacatcaacccttaaaacttgatataatgcgctttattatgaaaagttctagtaaattctttataaaatcaacttccagcagccttttcactttttattaataagttctttcttcaccttggctagtcaagataacaggtccatctttcgtaatgacaaattggtgttcatactgacatgacaatccaccatcaatggtcttatgcgcccaaccagtcttcatatctgtatcaatttcccagtcacctgtattgatcattggttcaatggttaagaccattccttcacgaagacggagtccacgaccagcaataccatagttaggaaccattggctcttcgtgcatggttgggccaacaccatgaccaaccaaatcacgcactacaccgtatccacgactttcagcatattcttgaatagctgctccaatatcaccaatacggttcccaacaacggcttgctctatccccttatacatggcttctttagttacatccatcagatttttcacttcttcggacggtgtaccaacagcataagcccaacaagagtctgctaggccaccagaatagctctgagtgtattttttcatttgttcaacattgttgaagtttaattttgagacattcaggtcagatttcgcaattggacctcccaaaaccatatcaactttgagcaaatcaccatctttcaagatatagtgacgagggaaagcatgagccacttcatcattaagagagcaacaggtagcataaggatagtccatcatggcaccatcaaccccaatctgaagtggaaggaaattctcttccttgcaacgacgtcggacatactcttcaacttcccacatatctacgcctggcttaatcaaatcacgtaagccgatatgaatacttgctagaaaatcaccagccttgtccatagcttcgatttcacgagctgattttaatgttatcattttttctcctagtttctaattaattttaacagtcacatttgcttttgaaacaatctgatgaccatgataaatatcgtaatcaataatagctgatcgtctagtatgatggatgatgcgtgcttgaatgcgcagtatatcatctatctgaactgcttgcaaaaagtagatcaacatctgctcaataatgagatttcgaccactattcacaactaaatcttgagtcatgtgggtcagaatttctgccaatacaccattagccaaaacaccgttcttctctagcataa

SEQ ID NO: 77 - DNA, 3240 bp, Streptococcus mitis NCTC 12261 contig23
taactgagtaccttgcagctggtgaaaaagttcaattgattggttttggtaactttgaagttcgtgagcgtgctgcacgtaaaggtcgcaacccacaaactggtaaagaaatcaaaattgcagcttctaaagttccagcattcaaagctggtaaagctcttaaagacgctgttaaataatcaaccttccaaaagcctattgtatcaagctttctagcttgggcagtaggctttttttgtgtataggaggcaaaaaagggccagaatctgaatgaactagtaccggaaaatatttcaagtacagactaattcaaattgcgtagcagaaatcatacaaatgaaattgattatagtaaaataggattagaattattaagaaagttggttttttattggaaacgatagtattttcaatctccgtttttttagcagggatcttgtccttcttttccccttgcatttttcctctgttacctgtttatactggaattttgctggatgatcaggaaagtgcaaaaagtttttctttgtttgggagaaaagttgcgtggtccggcttgattcgaacgctttgctttatcgtaggcatttcactcattttctttattctaggatttggtgctggttactttgggaatattctctatgccaattggtttcgctataccatgggaacaattattatcattttaggtcttcaccagatggaaatttttcattttaagaaattagaggttcaaaaaagctttacttttaagaaatcagaagccaatcgttattggtcggcctttttactcggtattacctttagctttggttggacgccttgtattggtcctgttttgagttctgttttagcgcttgcggcttctggaggaaatggcgcttggcaaggtgcaatctataccttgatttacactctggggatggcaattcctttcttgcttttggctctagcttcaggtgtagtaatgccttattttagtaaaattaaacgtcatatgatgctactgaagaaaaatggtgggttccctcatattttaatgggaattttgttactattaggacaagtaaatgttctagctggaatttttgaataaaggagaaaaagatgaaaaagtaatgtttgctgccttaagcctcttgtcattagtcgtattgatagcctgtggtgaggaagagactaaaaagactcaagctccacaacaatccccaaaacaacagcaacaaacgactgtacaacaaattgctgttggaaaagatgcgccagacttcaccttgcaatctatggatggtaaagaagttaagttatctgattataaggggaaaaaagtctacttgaagttttgggcttcatggtgtggtccatgtaagaaaagtatgcctgagttgatggaattagcggcgaaaccagatcgtgattttgaaattcttagtgtcattgcaccaggaattcaaggtgaaaaaactgtcgagcaattcccacaatggttccaagatcaaggttataaggatatcccagttctttatgacacaaaagcaaccacattccaagcttatcaaattcgaagcattcctacagaatacctgattgacagtcaaggaaagattgggaagattcaatttggtgttatcagcaatgcggatgcagaagcagcctttaaagaaatgaactagaatagataaaaatctgattacaagagagtagtcagatttttttaggaaaacattttataaatattcacaaatatcctatatttatggtaaaatagaatcatcattttattttggagtcaaagatgaatatatttagaacaaagaatgttagtttggataaaacagagatgcacaggcatttgaagttatgggatttgattttgctgggtatcggagccatggtagggacaggcgtctttacaattactggtactgcagccgcaactctagcgggtccagccctagtgatttcaattgtcatttctgccttatgtgtgggattatcagctctcttttttgcagaatttgcttcacgagtacctgctacaggtggtgcctacagttatctctatgctattttaggagaattcccagcctggttggcaggttggttaaccatgatggagttcatgacagccatatcgggtgtggcttctggttgggcagcgtattttaaagggcttctctctcaatacgggatagcccttcctcaggctttaaatggtacctttaatcctcaagcagggacgtttgttgatttattacctattcttgtcttggtcttggtgacctcgcttgttctacttaatgcgaaagccgccttacgctttaattcaattctagttattttgaaattttctgctttagctctctttgttttagtaggaatctggcatatcaagcttgataactggagtaattttgctccctatggttttggacaaatctatggtgccagtactggtattatggctggtgcgtccttgatgttctttggttttttggggtttgaatccatctctatggctgtagatgaggtcaagactcctcaaaaaaatattcctagagggattgtcttatcgctttctatcgtaaccattctttatgccttggtgacgcttgttttgactggtgtggttcactatagtcatctaaatgtcgacgatgccgttgcctttgcccttcgtagcgttgggattagttgggcagctagttatgtgtcattagtggctatcttaaccttgattacggtttgtatctcaatgacttatgccctatctcgtatgatttacagtttagcgcgtgacggattgatgcctgctgcctttaaagaactgaccaaaacaagcaaggtaccaaaaaatgctactatcttgacaggtctagcttcagcagtagcagcaggaatgttccctcttgctagtatcgcagccttcttaaatatttgtaccttggcctacttgatcatgctggcttatggtctgattcgattacggaaagaaaaaggaatgcccaaagcaggagaatttaaaacaccactggtacccttattaccgattttatcaatcatcatttgtttatcatttatgttgcagtataatatggaaacctggattgctttcctagttgcattgttagtaggaagtattatttactttacttatggttataagcattctaccatagaagaataatactcttcgaaaatctcttcaaaccacgtcagcttcgccttgccgtatgc

SEQ ID NO: 78 - DNA, 4773 bp, Streptococcus mitis NCTC 12261 contig24
tgatgcattcaaaatctataactaattgatagaaattaaggtgaaggcgagttgggggactaactcgcttttataatcaattcatctcttttttaagaggatggattgtgatagtatgagatagtctaggagaaaatgatgttaagttcaaaagatataatcaaggctcacaaggtcttgaatggtgtggttgtgaataccccactggattacgaccattatttatcggagaagtatggtgctaagatttatttgaaaaaagaaaatgcccaacgtgttcgctcttttaaaattcgtggtgcctattatgccatttcccagctcagcaaggaagaacgtgagcgtggggtagtctgcgcttctgcggggaatcatgcgcagggagttgcctatacttgcaatgaaatgaagattcctgcaactattttcatgccaattactactccgcaacaaaagattggtcaagttcgcttttttggtggggacttcgtgactattaaattagttggagatacttttgatgcctcagccaaagcagctcaagaatttacagtctctgaaaatcgtacctttattgatccctttgatgatgcccatgttcaagctggtcaagggacagttgcttatgagattttagaagaagctcgaaaagaatcgattgattttgatgctgttttggtccctgttggtggcggtggtctcattgctggggtttctacctatatcaaggaaataagtccagagattgaagtcattggggtagaggctaatggagcgcgttccatgaaggctgcctttgaagctggtggaccagtcaaactcaaagaaattgacaaatttgcggatgggattgctgtgcaaaaggtaggtcagttgacctatgaagcaactcgtcaacatgttcaaactttggtaggtgtcgatgagggattgatttctgaaaccttgattgacctttattctaagcaagggatagtcgcagagcctgctggagcagctagtatcgcctctctagaggttttagctgaatatatcaaggggaaaaccatttgttgtatcatttctggaggaaataatgatatcaaccgtatgccagaaatggaggagcgcgccttgatttatgatgggatcaagcattactttgtggttaattttccacagcgtccaggggccttgcgtgagtttgtaaatgatatcttggggccaaatgatgatatcacacgttttgagtatattaagcgagctagcaaggggacaggcccagtattaattgggattgccttggcagataagcatgattatgcaggattgattcgtcgaatggaaggttttgatccagcttatattaacttaaatggtaacgaaacgctctataatatgcttgtctgaggactaataaaaaaatatcatattatttgcacaattgatgtataggtgctataatgaagatgaagaaagggggcgattcctatggacttaggaaatcggttacgctatttctatcataactcattatagtacctatgttttttgattcagtttatagtaagggagtaaaattacttgttatatgtaaggagttttttgaaatctactattttatatatagctaatctgaaatttggctaaatataataggaattagaaaaaataatcaatactaatgagaagccttatactgagttaactgagaagagtgataagatactaagaagataaaaacagtggaaaatgttggaagataggatactattgtttcctaactactcatctttttataggtttgaagaaataaaaaggaatattgataaagtaaataaatagtacaagttgaccaaatgattgaatgctggtgtagacaggaaaagtctaaaagtagaaaaatactcgttagaaatggtttagagcagaagatttttttgtcaaatttttttgttttgcagtggaataaataatatgaaataagactagaatatgtctagattatcgagaatcagcatctgacaaatatgaatattattacatgaataagatttaataatacagttgctttaaagaactataaaaattgttttcggcaatgaaaaacctatatattataaactttaataagatagcaagtaaaaataagggcgtttattttattgaatatatgtttttttattgacaaaaagcataaaaacgtatacaattaaaagcgtatacaattaaatatcgtaaataagaaaataggagaaggacatggctaagtcaaactttgaaaaagtagaatcagttgttggctgggttcgtgataagaaaatcacaggctaccgtatctctaaagaaacgaatgcgcgtgaaatgtctatcattgctctagcacaggggcgtgcaaaagtaaaaaatatttcgtttgaaacggctctaggtttaattgatttctatgataaaaatcatgaaaaatttgaagattaatctttggataatggcggattcttgaatagggtctgccttttcattttttggctagtaaaaagactgcacggttgatgcagccttttctttttatttgagatagcgttgaaggaattcttttgtacggtcttctttaggattggtgaagaggtcttctggtttgccttcttcagcaatcacacctttatccataaagataacacggtgagagacatcacgggcgaattccatttcgtgagttacgacaatcatagtcaagccttcttgagccaggtcctgcatgattttgaggacttctccaaccatttctggatcgagagctgatgttggttcatcaaagagaatagcatctggattcatggagagggcacgagcgatggccacacgttgtttttgaccacctgagagttgttttggtttcgcttgccagtagcgttctcccatgccgaccttttccaggttttctttggcaatcttttcagcttctgtacgttcgcgtttaaggacagttgtctgagcgacaattgtgttttcaagaacgttgagattttcaaagaggttaaaggattggaacaccatccccaacttttcacggtattgcgtgaggtcatagcctttttcgaggacgttttgtccatgataaaggatttgtccatcagttggcgtttcaaggaggttaatggagcgtaggaaggttgattttccgcttccagagcttccgatgatagagattacctctcccttgtggacagtgagtgaaatgtcttttagcacttcgttttgtccataggattttttgaggtgtttaatttcaaggattgcttgtgtcattatttcaaatcctccgtttgcatttggttagcacctgtagtataggtatccatgtccatgcggcgttcgatgaagcgtaggatacgtgttacggtgaaggtgaggacaaagtaaatcacggcgatgattgtaaatgtttggaagtattgataggtttgagttgccacggtatttcctgagaaataaagttcaacaacagagataacgttcaatacagatgtatctttgatattgatgacaaattcattaccagttgctggtaggatgttacggactacttgaggtaggacaatcttacgcatggtttggttatgggtcataccaagagcagtcgctgcttcaaattgtcccttatcaactgctaggataccaccacggacgatttcagtcatgtaggcaccggtgttgatcgaaacgatgaagatagcagccagtgtgcggtcaaggttgataccgaaagcttgagcagttccgtagtagataaccatcgattgaacgatcattggcgttccacggaaaatttcgatatagacattgagaccccatccgactagtttttgtaggctgtaaatagctttgttttcagagagaggagcagtacggaaaacaccaatagcaagaccgataatgagacctatgatggttccgacgatagagattaaaagagtgatacccgcaccacgcaagagttgttgccagttttcagaaagaattttagcgacttggttaaagaaactactgctagtctcttcagttgttgttgcttcggcaggttgctccttgatcatacgatccattagggcaacttgctcatcttttgaaatggtttcaatgctggcattgatttggctaatacgagtgtcatctttacgaagtccaatggcaatagctgtatcttcttcccccgttttgaaacctggttctacttgaaccatcttgaacttagagttagcagcttcggcagtcagagcttctggacgttcagaaacataggcatcaatgacaccagcctcaagtgcttggcgcatttgagcgaagtctcccatggcagtttcttttttagcgcctgagatttgggaaatcaagtcataaaggtaaacaccttgttgagaagtgattttcgctccattaaagtcatccaaagatttggcatttgcataggcagaatcttttttgacaagtaggacaggctcgctagtgtagtagctgcttgaaaaggcgatttcttgtttgcgttcagcggttggactcatacctgcgataatcatgtcaatcttaccagaagtaagggcaggaactaaaccttcccacttggttttaacaaccaaaggttctttacctaagtccttagcgattttcttggcaatttggacatcgtatccattggcatactggttggttccatcgattttgacagctccgttgctatcatcatcctgggtccagttaaagggagcatatgctgcttccatcccgatgcgtaaa

SEQ ID NO: 79 - DNA, 342 bp, Artificial Sequence
  Fusion construct between Streptococcus mitis pulA and Human immunodeficiency virus T20
atggtctacagcatccgttccctcaaaaatggaactggttctgtccttattggagcaagccttattctgcttgccatggctacaccaactatctcagcaaacgaaaatacaccaaccactaacgaacccagcaacagaaatacgacctcccttactcaacctcttactgatgcaacaaacatcgctggcaagaacgaaagcgatttttcttcacccgatagtgcaaacgcttcctatacatcactcattcactcactcatcgaagaatcacaaaatcagcaggaaaaaaacgaacaagaattattagaattagacaaatgggcatcactttggaattggttt

SEQ ID NO: 80 - protein, 114 aa, Artificial Sequence
  Fusion construct between Streptococcus mitis pulA and Human immunodeficiency virus T20
MVYSIRSLKNGTGSVLIGASLILLAMATPTISANENTPTTNEPSNRNTTSLTQPLTDATNIAGKNESDFSSPDSANASYTSLIHSLIEESQNQQEKNEQELLELDKWASLWNWF

What is claimed is:

1. An integrally transformed non-pathogenic, commensal bacterium that expresses a synthetic nucleic acid molecule encoding a foreign fusion polypeptide comprising a HIV T20 polypeptide inhibitor and a signal polypeptide therein, wherein the synthetic nucleic acid molecule is stably integrated into genomic DNA of the bacterium, wherein the bacterium is *Streptococcus mitis*, wherein the signal polypeptide is pullulanase polypeptide, wherein said bacterium expresses or secretes the HIV T20 polypeptide inhibitor/pullulanase foreign fusion polypeptide, and wherein the HIV T20 polypeptide inhibitor/pullulanase foreign fusion polypeptide comprises the amino acid sequence set forth in SEQ ID NO: 80.

2. The integrally transformed non-pathogenic, commensal bacterium of claim 1, wherein the nucleic acid molecule encoding the foreign fusion polypeptide is expressed in the cytoplasm, in the cell membrane or cell wall, or exports to the cell surface of the bacterium.

3. The integrally transformed non-pathogenic, commensal bacterium of claim 1, wherein the nucleic acid molecule encoding the HIV T20 polypeptide inhibitor/pullulanase foreign fusion polypeptide comprises SEQ ID NO: 79.

4. The foreign fusion polypeptide expressed by the integrally transformed non-pathogenic, commensal bacterium of claim 1.

5. A method of delivering a foreign protein to an individual, comprising: contacting the integrally transformed non-pathogenic, commensal bacterium of claim 1 with tissue of the oral cavity or upper respiratory tract of the individual in an amount sufficient for colonization of said bacterium.

* * * * *

UNITED STATES PATENT AND TRADEMARK OFFICE

CERTIFICATE OF CORRECTION

PATENT NO. : 9,884,108 B2
APPLICATION NO. : 15/172947
DATED : February 6, 2018
INVENTOR(S) : Antonio Campos-Neto et al.

It is certified that error appears in the above-identified patent and that said Letters Patent is hereby corrected as shown below:

In the Specification

Column 1, Lines 17-22, please delete:
"The invention was supported, in whole or in part, by a grant R01AI076425 from National Institutes of Health-National Institute of Allergy and Infectious Disease and by a grant R01DE015931 from National Institutes of Health, National Institute of Dental and Craniofacial Research. The Government has certain rights in the invention."

And replace with:
-- This invention was made with government support under grants R01 AI076425 and R01DE015931 awarded by the National Institutes of Health. The Government has certain rights in the invention. --

Signed and Sealed this
Thirtieth Day of July, 2019

Andrei Iancu
*Director of the United States Patent and Trademark Office*